(12) United States Patent
Plouët et al.

(10) Patent No.: US 8,420,780 B2
(45) Date of Patent: Apr. 16, 2013

(54) MUTATED NETRIN 4, FRAGMENTS THEREOF AND USES THEREOF AS DRUGS

(75) Inventors: Jean Plouët, Paris (FR); Isabelle Clarisse Solange Plouët, legal representative, Paris (FR); Claire Charlotte Plouët, legal representative, Paris (FR); Anne Florence Plouët, legal representative, Paris (FR); Laurence Leconte, Antony (FR); Esma Lejmi, Issy les Moulineaux (FR)

(73) Assignees: INSERM (Institut National de la Sante et de la Recherche Medicale), Paris (FR); Centre National de la Recherche Scientifique, Paris (FR); IVS Institut des Vaisseaux et du Sang, Paris (FR)

( * ) Notice: Subject to any disclaimer, the term of this patent is extended or adjusted under 35 U.S.C. 154(b) by 602 days.

(21) Appl. No.: 12/523,074

(22) PCT Filed: Jan. 21, 2008

(86) PCT No.: PCT/EP2008/050662
§ 371 (c)(1), (2), (4) Date: Jul. 14, 2009

(87) PCT Pub. No.: WO2008/087224
PCT Pub. Date: Jul. 24, 2008

(65) Prior Publication Data
US 2010/0247520 A1     Sep. 30, 2010

(30) Foreign Application Priority Data
Jan. 19, 2007 (EP) .................................. 07290075

(51) Int. Cl.
*C07K 1/00* (2006.01)
*C07K 14/00* (2006.01)
*C07K 17/00* (2006.01)
*G01N 33/00* (2006.01)
*A01N 61/00* (2006.01)
*A61K 31/00* (2006.01)
*C12N 5/00* (2006.01)
*C12N 5/02* (2006.01)
*C12N 5/08* (2006.01)

(52) U.S. Cl.
USPC .............. 530/350; 436/86; 514/1; 514/1.1; 435/325; 435/366

(58) Field of Classification Search ..................... None
See application file for complete search history.

(56) References Cited

U.S. PATENT DOCUMENTS
7,358,351 B2 * 4/2008 St. Croix et al. ............. 536/23.1

FOREIGN PATENT DOCUMENTS
WO     2006054000     5/2006

OTHER PUBLICATIONS

Chamberlain et al. Expert Opinion on Pharmcotherapy 1(4): 603-614, 2000.*
Johnson and Goldin. Cancer Treatment Reviews 2: 1-31, 1975.*
Gura et al. Science 278: 1041-1042, Nov. 7, 1997.*
International search report in corresponding PCT/EP2008/050662, May 31, 2008.
DATABASE UniProt, "Netrin-4 precursor (Beta-netrin) (Hepar-derived netrin-like protein)", Sep. 27, 2005, XP002438261.
Wilson Brent D et al., "Netrins promote developmental and therapeutic angiogenesis", Science, vol. 313, No. 5787, Aug. 2006, pp. 640-644, XP002438038.
Quigley E., "Inhibiting angiogenesis: Interview with Dr. Jean Plouet", Expert Opinion on Therapeutic Targets 2006 United Kingdom, vol. 10, No. 4, 2006, pp. 501-503, XP002438039.
Zhang C et al., "Identification of a novel alternative splicing form of human netrin-4 and analyzing the expression patterns in adult rat brain", Molecular Brain Research, Elsevier Science BV, Amsterdam, NL, vol. 130, No. 1-2, Nov. 4, 2004, pp. 68-80, XP004618522.

* cited by examiner

*Primary Examiner* — Alana Harris Dent
(74) *Attorney, Agent, or Firm* — Young & Thompson

(57) ABSTRACT

Proteins having the amino acid sequence of SEQ ID NO: 2 or SEQ ID NO: 4, or fragments of said sequences are provided. The protein fragments are represented by the sequences of SEQ ID NO: 2q, q varying from 3 to 36, and the sequences of SEQ ID NO: 185 to SEQ ID NO: 209. Nucleotide sequences coding for said proteins are also provided.

4 Claims, 9 Drawing Sheets

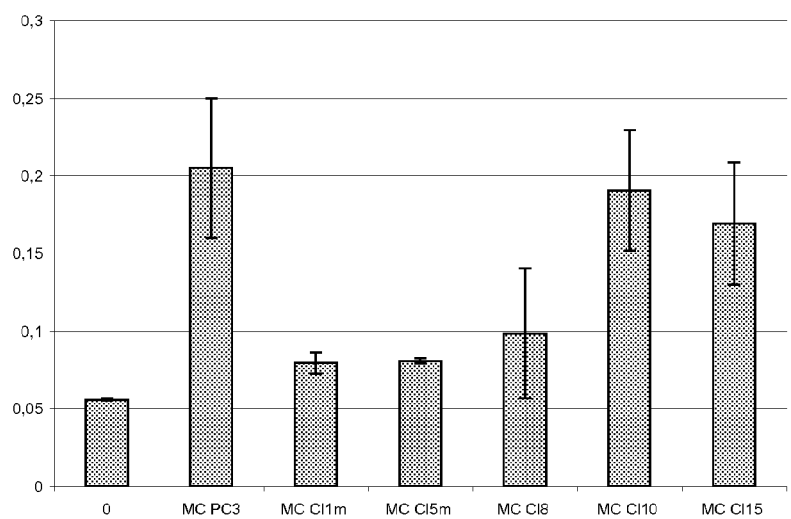
FIGURE 2
FIGURE 3A
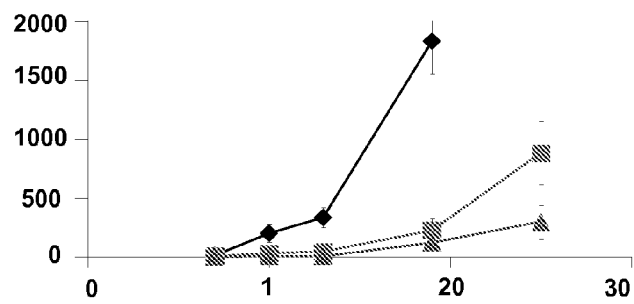
FIGURE 3B
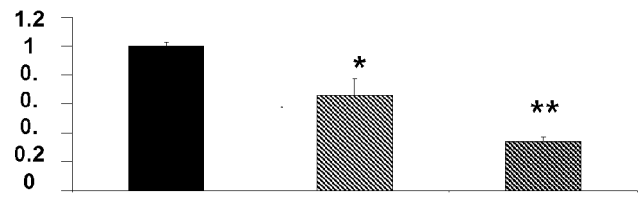
FIGURE 3C
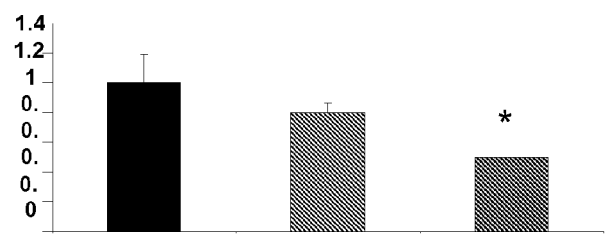

FIGURE 4A
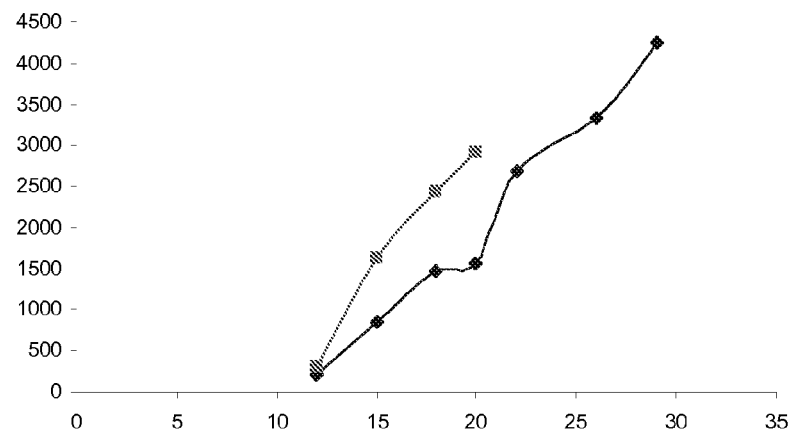
FIGURE 4B
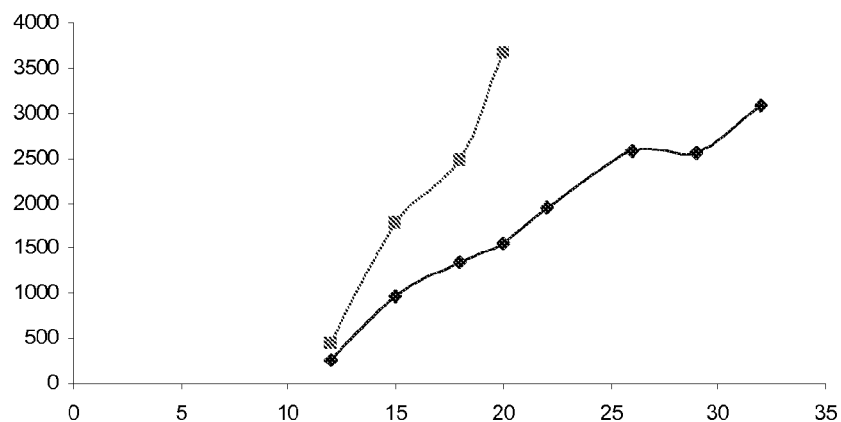
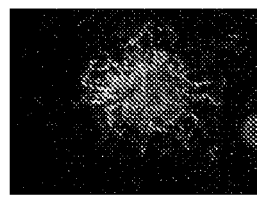    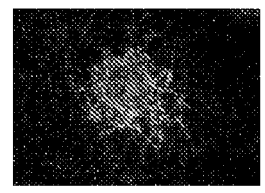    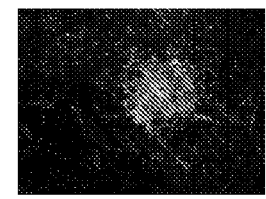
FIGURE 5A            FIGURE 5B            FIGURE 5C

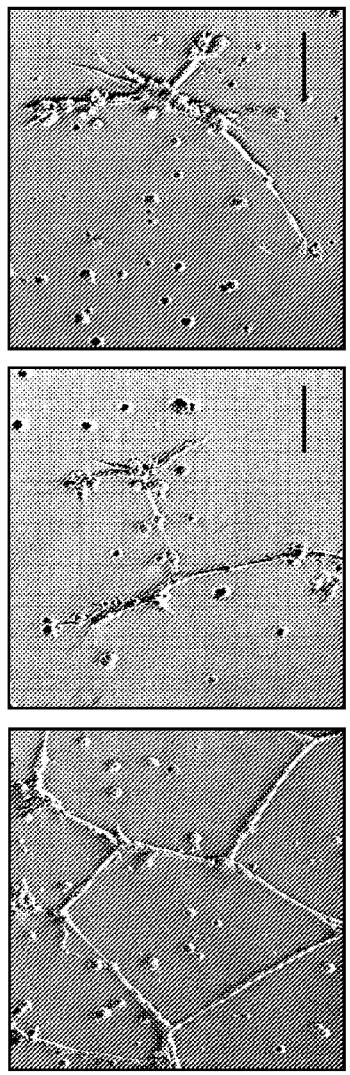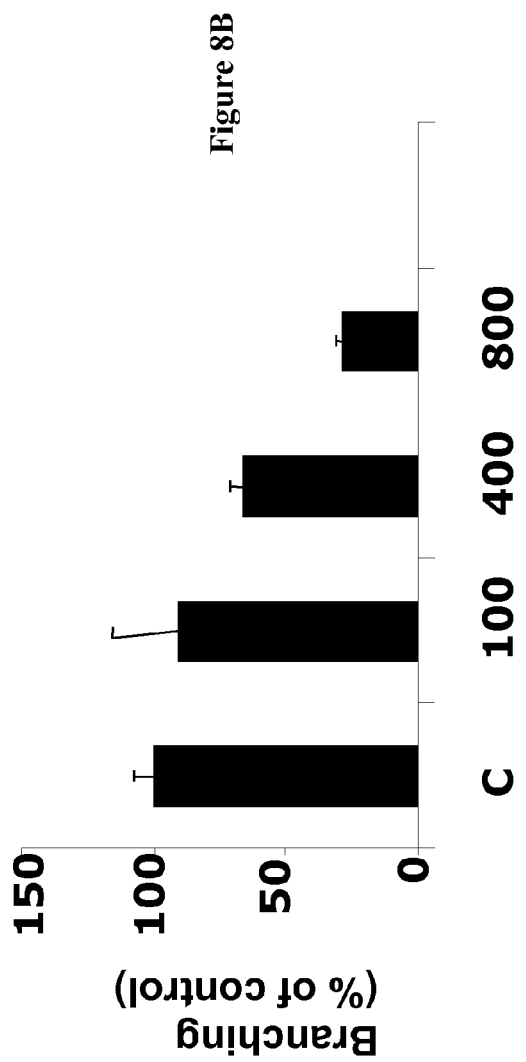

FIGURE 9C
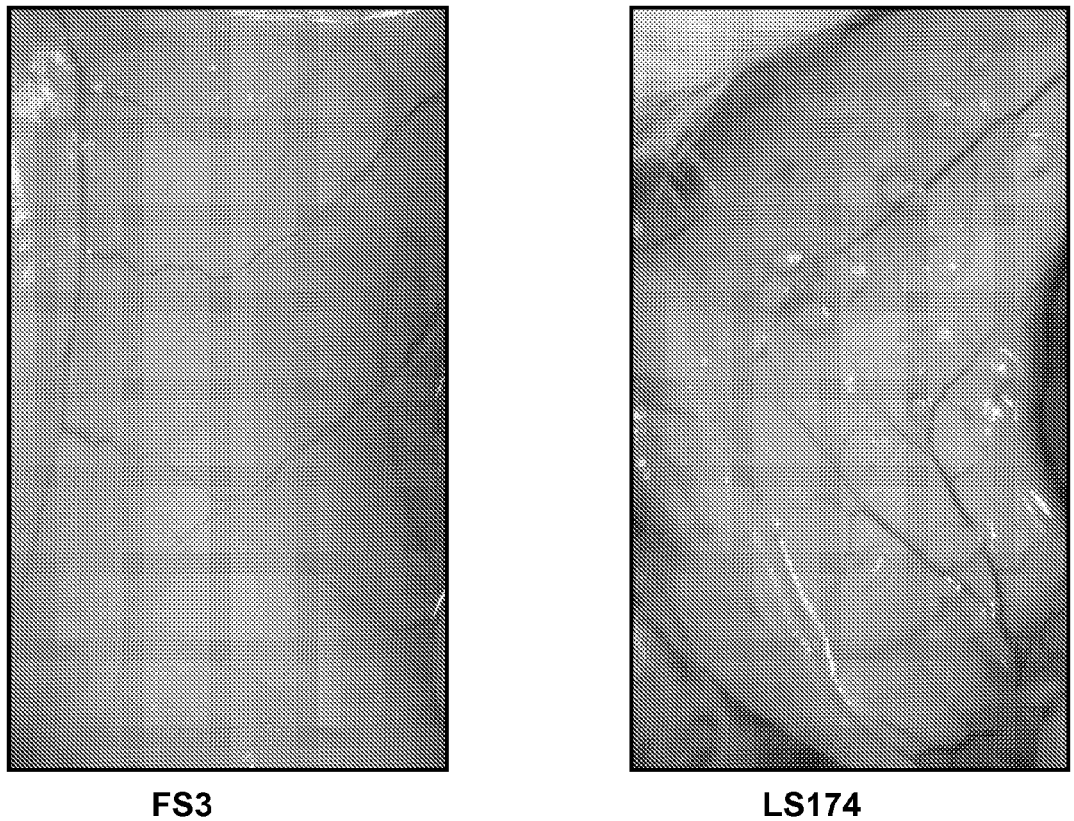
FS3                LS174
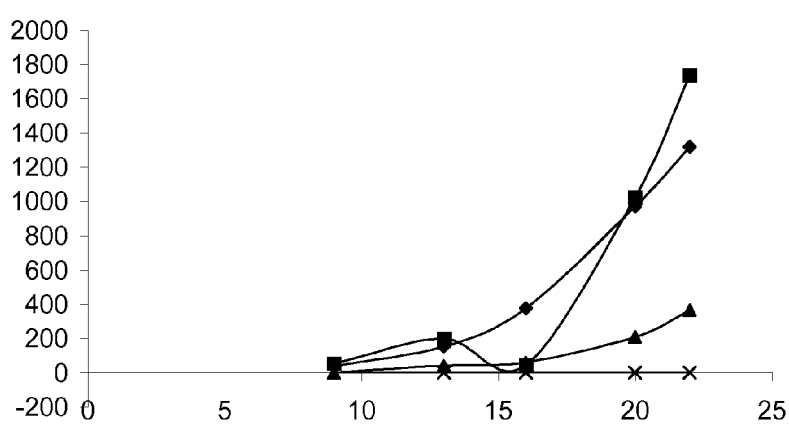
FIGURE 10

MUTATED NETRIN 4, FRAGMENTS THEREOF AND USES THEREOF AS DRUGS

FIELD OF THE INVENTION

The present invention relates to a mutated netrin 4, and fragments thereof. It also relates to the use of said mutated netrin 4 and said fragments as drugs, in particular as anti-angiogenic agents.

BACKGROUND OF THE INVENTION

Netrin 4 belongs to the netrins family, which are axons guiding molecules. To this day, 4 members of this family are known (netrins 1, G, 3, and 4). Netrin 4 is a protein consisting of a basic C-terminal domain interacting with heparin, 3 EGF-domains, and a laminin-domain (Yucchenco P D, Wadsworth W G (2004) Assembly and tissue functions of early embryonic laminins and netrins. *Curr Opin Cell Biol.* 16(5): 572-9).

Patent application US 2003/0207347A1, published on Nov. 6, 2003, describes the native netrin 4 and uses thereof. More particularly, this application describes a netrin 4-derived polypeptide presenting properties for modulating angiogenesis, as well as the use of netrin 4 in a process of modulation of the vascular development, in particular of angiogenesis, and more particularly of inhibition of angiogenesis, in particular in tumors.

International patent application WO 2006/054000 describes the use of a mutated netrin 4 for the preparation of a drug for the prevention or the treatment of tumoral or non-tumoral pathologies, said mutated netrin 4 having an anti-angiogenic activity.

However, among sequences disclosed in this document, some improper mutated netrin 4 sequences comprise errors of sequencing.

An aim of the present invention is to provide new anti-angiogenic agents.

Another aim of the present invention is to provide a combination treatment allowing the increase of the treatments' efficiency involving angiogenesis, and in particular of usual anti-tumoral treatments, or of anti-angiogenic treatments used in pathologies other than tumors.

Until today, there is no known therapeutic agent able to interact with usual drugs as used for the treatment of age-related macular degeneration, or of other ocular diseases involving a neovascularization.

SUMMARY OF THE INVENTION

The present invention relates to a protein comprising or consisting of one of the following sequences:
- the sequence SEQ ID NO: 2 or SEQ ID NO: 4, or
- a fragment of said sequence represented by one of the sequences SEQ ID NO: 2q, q varying from 3 to 36, or
- one of the sequences chosen among the group consisting in SEQ ID NO: 185 to SEQ ID NO: 209.

The above-mentioned protein SEQ ID NO: 2 is a new protein corresponding to the mutated netrin 4 and the above-mentioned protein SEQ ID NO: 4 relates to the protein SEQ ID NO: 2 without a signal peptide.

The sequence SEQ ID NO: 2 comprises 628 amino acids and the sequence SEQ ID NO: 4 comprises 609 amino acids and is a fragment of SEQ ID NO: 2 from residue 20 to residue 628.

The mutated netrin 4, represented by the sequence SEQ ID NO: 2, corresponds to the netrin 4 protein represented by SEQ ID NO: 178 with the following 15 mutations:
- replacement of cysteine in position 13 by arginine,
- replacement of lysine in position 68 by threonine,
- replacement of serine in position 183 by proline,
- replacement of histidine in position 205 by tyrosine,
- replacement of cysteine in position 234 by tyrosine,
- replacement of alanine in position 331 by threonine,
- replacement of cysteine in position 332 by arginine,
- replacement of asparagine in position 353 by serine,
- replacement of cysteine in position 472 by tyrosine,
- replacement of asparagine in position 515 by lysine,
- replacement of valine in position 589 by alanine,
- replacement of arginine in position 625 by glutamate,
- replacement of glutamate in position 626 by serine,
- replacement of cysteine in position 627 by alanine,
- replacement of lysine in position 628 by serine.

The above-mentioned fragments, corresponding to protein sequences SEQ ID NO: 6 to SEQ ID NO: 72, are new fragments of the above-mentioned mutated netrin 4.

The above-mentioned sequences SEQ ID NO: 2q correspond to protein sequences SEQ ID NO: 6 to 72, and thus are the following protein sequences: SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, and SEQ ID NO: 72.

DETAILED DESCRIPTION OF THE INVENTION

The sequence SEQ ID NO: 6 is an EGF-fragment of the human mutated netrin 4, said fragment being coded by the nucleotide sequence SEQ ID NO: 5. This fragment comprises 255 amino acids and corresponds to a fragment of the mutated netrin 4 from residue 261 to residue 515 of sequence SEQ ID NO: 2.

The sequence SEQ ID NO: 8 is a fragment of the mutated netrin 4, being coded by the nucleotide sequence SEQ ID NO: 7. This fragment comprises 515 amino acids and corresponds to a fragment of the mutated netrin 4 from residue 1 to residue 515 of sequence SEQ ID NO: 2.

The fragments of the mutated netrin 4 corresponding to protein sequences SEQ ID NO: 10 to SEQ ID NO: 72, as well as the corresponding nucleotide sequences SEQ ID NO: 9 to SEQ ID NO: 71 are represented in the following table:

| Protein sequence | Nucleotide sequence | Positions of the fragment in the sequence SEQ ID NO: 2 |
| --- | --- | --- |
| SEQ ID NO: 10 | SEQ ID NO: 9 | 32-515 |
| SEQ ID NO: 12 | SEQ ID NO: 11 | 32-628 |
| SEQ ID NO: 14 | SEQ ID NO: 13 | 1-260 + 516-628 |
| SEQ ID NO: 16 | SEQ ID NO: 15 | 261-628 |
| SEQ ID NO: 18 | SEQ ID NO: 17 | 332-387 + 516-628 |
| SEQ ID NO: 20 | SEQ ID NO: 19 | 32-260 + 516-628 |
| SEQ ID NO: 22 | SEQ ID NO: 21 | 32-320 + 516-628 |
| SEQ ID NO: 24 | SEQ ID NO: 23 | 32-260 + 332-387 + 516-628 |
| SEQ ID NO: 26 | SEQ ID NO: 25 | 32-260 + 394-445 + 516-628 |
| SEQ ID NO: 28 | SEQ ID NO: 27 | 1-320 + 516-628 |
| SEQ ID NO: 30 | SEQ ID NO: 29 | 1-260 + 332-387 + 516-628 |

-continued

| Protein sequence | Nucleotide sequence | Positions of the fragment in the sequence SEQ ID NO: 2 |
|---|---|---|
| SEQ ID NO: 32 | SEQ ID NO: 31 | 1-260 + 394-445 + 516-628 |
| SEQ ID NO: 34 | SEQ ID NO: 33 | 261-320 + 332-387 + 516-628 |
| SEQ ID NO: 36 | SEQ ID NO: 35 | 332-387 + 394-445 + 516-628 |
| SEQ ID NO: 38 | SEQ ID NO: 37 | 261-320 + 332-387 + 394-445 + 516-628 |
| SEQ ID NO: 40 | SEQ ID NO: 39 | 1-320 + 332-387 + 516-628 |
| SEQ ID NO: 42 | SEQ ID NO: 41 | 1-260 + 332-387 + 394-445 + 516-628 |
| SEQ ID NO: 44 | SEQ ID NO: 43 | 1-320 + 394-445 + 516-628 |
| SEQ ID NO: 46 | SEQ ID NO: 45 | 32-320 + 332-387 + 516-628 |
| SEQ ID NO: 48 | SEQ ID NO: 47 | 32-260 + 332-387 + 394-445 + 516-628 |
| SEQ ID NO: 50 | SEQ ID NO: 49 | 32-320 + 394-445 + 516-628 |
| SEQ ID NO: 52 | SEQ ID NO: 51 | 1-320 + 332-387 + 394-445 + 516-628 |
| SEQ ID NO: 54 | SEQ ID NO: 53 | 32-320 + 332-387 + 394-445 + 516-628 |
| SEQ ID NO: 56 | SEQ ID NO: 55 | 20-515 |
| SEQ ID NO: 58 | SEQ ID NO: 57 | 20-260 + 516-628 |
| SEQ ID NO: 60 | SEQ ID NO: 59 | 20-320 + 516-628 |
| SEQ ID NO: 62 | SEQ ID NO: 61 | 20-260 + 332-387 + 516-628 |
| SEQ ID NO: 64 | SEQ ID NO: 63 | 20-260 + 394-445 + 516-628 |
| SEQ ID NO: 66 | SEQ ID NO: 65 | 20-320 + 332-387 + 516-628 |
| SEQ ID NO: 68 | SEQ ID NO: 67 | 20-260 + 332-387 + 394-445 + 516-628 |
| SEQ ID NO: 70 | SEQ ID NO: 69 | 20-320 + 394-445 + 516-628 |
| SEQ ID NO: 72 | SEQ ID NO: 71 | 20-320 + 332-387 + 394-445 + 516-628 |

The above-mentioned proteins SEQ ID NO:185 to SEQ ID NO:209 are new proteins corresponding to the mutated netrin 4.

The mutated netrin 4, represented by the sequence SEQ ID NO: 185, corresponds to the netrin 4 protein represented by SEQ ID NO: 178 with the following 14 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of alanine in position 331 by threonine,
  replacement of cysteine in position 332 by arginine,
  replacement of asparagine in position 353 by serine,
  replacement of cysteine in position 472 by tyrosine,
  replacement of asparagine in position 515 by lysine,
  replacement of valine in position 589 by alanine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 186, corresponds to the netrin 4 protein represented by SEQ ID NO: 178 with the following 13 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of cysteine in position 332 by arginine,
  replacement of asparagine in position 353 by serine,
  replacement of cysteine in position 472 by tyrosine,
  replacement of asparagine in position 515 by lysine,
  replacement of valine in position 589 by alanine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 187, corresponds to the netrin 4 protein represented by SEQ ID NO: 178 with the following 13 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of alanine in position 331 by threonine,
  replacement of asparagine in position 353 by serine,
  replacement of cysteine in position 472 by tyrosine,
  replacement of asparagine in position 515 by lysine,
  replacement of valine in position 589 by alanine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 188, corresponds to the netrin 4 protein represented by SEQ ID NO: 178 with the following 12 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of asparagine in position 353 by serine,
  replacement of cysteine in position 472 by tyrosine,
  replacement of asparagine in position 515 by lysine,
  replacement of valine in position 589 by alanine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 189, corresponds to the netrin 4 protein represented by SEQ ID NO: 178 with the following 14 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of alanine in position 331 by threonine,
  replacement of cysteine in position 332 by arginine,
  replacement of asparagine in position 353 by serine,
  replacement of asparagine in position 515 by lysine,
  replacement of valine in position 589 by alanine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 190, corresponds to the netrin 4 protein represented by SEQ ID NO: 178 with the following 14 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of alanine in position 331 by threonine,
  replacement of cysteine in position 332 by arginine,
  replacement of asparagine in position 353 by serine,
  replacement of cysteine in position 472 by tyrosine,
  replacement of asparagine in position 515 by lysine,
  replacement of arginine in position 625 by glutamate,
  replacement of glutamate in position 626 by serine,
  replacement of cysteine in position 627 by alanine, and
  replacement of lysine in position 628 by serine.

The mutated netrin 4, represented by the sequence SEQ ID NO: 191, corresponds to the netrin 4 protein represented by SEQ ID NO: 178 with the following 14 mutations:
  replacement of lysine in position 68 by threonine,
  replacement of serine in position 183 by proline,
  replacement of histidine in position 205 by tyrosine,
  replacement of cysteine in position 234 by tyrosine,
  replacement of alanine in position 331 by threonine,
  replacement of cysteine in position 332 by arginine,
  replacement of asparagine in position 353 by serine,
  replacement of cysteine in position 472 by tyrosine, and
  replacement of asparagine in position 515 by lysine.

The mutated netrin 4 corresponding to protein sequences SEQ ID NO: 2 and SEQ ID NO: 185 to SEQ ID NO: 191, and the native netrin 4 corresponding to protein sequence SEQ ID NO: 178, as well as the corresponding mutations are represented in the following table:

| Protein sequence | Amino acid position | | | | | | | | | | | | | | |
|---|---|---|---|---|---|---|---|---|---|---|---|---|---|---|---|
| | 13 | 68 | 183 | 205 | 234 | 331 | 332 | 353 | 472 | 515 | 589 | 625 | 626 | 627 | 628 |
| SEQ ID NO: 2 | R | T | P | Y | Y | T | R | S | Y | K | A | E | S | A | S |
| SEQ ID NO: 178 | C | K | S | H | C | A | C | N | C | N | V | R | K | C | K |
| SEQ ID NO: 185 | C | T | P | Y | Y | T | R | S | Y | K | A | E | S | A | S |
| SEQ ID NO: 186 | C | T | P | Y | Y | A | R | S | Y | K | A | E | S | A | S |
| SEQ ID NO: 187 | C | T | P | Y | Y | T | C | S | Y | K | A | E | S | A | S |
| SEQ ID NO: 188 | C | T | P | Y | Y | A | C | S | Y | K | A | E | S | A | S |
| SEQ ID NO: 189 | C | T | P | Y | Y | T | R | S | C | K | A | E | S | A | S |
| SEQ ID NO: 190 | C | T | P | Y | Y | T | R | S | Y | K | V | E | S | A | S |
| SEQ ID NO: 191 | C | T | P | Y | Y | T | R | S | Y | K | V | R | K | C | K |

The above-mentioned proteins corresponding to protein sequences SEQ ID NO: 185 to SEQ ID NO: 191 correspond to the substitution mutants of netrin 4 (sNET-4m) 1 to 7 (see example section).

The mutated netrin 4, represented by the sequence SEQ ID NO: 192, corresponds to the netrin 4 protein represented by SEQ ID NO: 178 with the following mutation:
replacement of cysteine in position 472 by tyrosine.

The mutated netrin 4, represented by the sequence SEQ ID NO: 193, corresponds to mutated netrin 4 represented by SEQ ID NO: 192 wherein amino acids 516 to 618 have been deleted, and the mutated netrin 4, represented by the sequence SEQ ID NO: 204, corresponds to mutated netrin 4 represented by SEQ ID NO: 192 wherein amino acids 478 to 618 have been deleted.

The mutated netrin 4, represented by the sequence SEQ ID NO: 194, corresponds to the netrin 4 protein represented by SEQ ID NO: 178 with the following mutation:
replacement of asparagine in position 353 by serine.

The mutated netrin 4, represented by the sequence SEQ ID NO: 195, corresponds to mutated netrin 4 represented by SEQ ID NO: 194 wherein amino acids 516 to 618 have been deleted and the mutated netrin 4, represented by the sequence SEQ ID NO: 205, corresponds to mutated netrin 4 represented by SEQ ID NO: 194 wherein amino acids 478 to 618 have been deleted.

The mutated netrin 4, represented by the sequence SEQ ID NO: 196, corresponds to the netrin 4 protein represented by SEQ ID NO: 178 with the two following mutations:
replacement of asparagine in position 353 by serine, and
replacement of cysteine in position 472 by tyrosine.

The mutated netrin 4, represented by the sequence SEQ ID NO: 197, corresponds to mutated netrin 4 represented by SEQ ID NO: 196 wherein amino acids 516 to 618 have been deleted and the mutated netrin 4, represented by the sequence SEQ ID NO: 206, corresponds to mutated netrin 4 represented by SEQ ID NO: 196 wherein amino acids 478 to 618 have been deleted.

The mutated netrin 4, represented by the sequence SEQ ID NO: 198, corresponds to the netrin 4 protein represented by SEQ ID NO: 178 with the two following mutations:
replacement of cysteine in position 332 by arginine, and
replacement of cysteine in position 472 by tyrosine.

The mutated netrin 4, represented by the sequence SEQ ID NO: 199, corresponds to mutated netrin 4 represented by SEQ ID NO: 198 wherein amino acids 516 to 618 have been deleted and the mutated netrin 4, represented by the sequence SEQ ID NO: 207, corresponds to mutated netrin 4 represented by SEQ ID NO: 198 wherein amino acids 478 to 618 have been deleted.

The mutated netrin 4, represented by the sequence SEQ ID NO: 200, corresponds to the netrin 4 protein represented by SEQ ID NO: 178 with the three following mutations:
replacement of cysteine in position 332 by arginine,
replacement of asparagine in position 353 by serine, and
replacement of cysteine in position 472 by tyrosine.

The mutated netrin 4, represented by the sequence SEQ ID NO: 201, corresponds to mutated netrin 4 represented by SEQ ID NO: 200 wherein amino acids 516 to 618 have been deleted and the mutated netrin 4, represented by the sequence SEQ ID NO: 208, corresponds to mutated netrin 4 represented by SEQ ID NO: 200 wherein amino acids 478 to 618 have been deleted.

The mutated netrin 4, represented by the sequence SEQ ID NO: 202, corresponds to the netrin 4 protein represented by SEQ ID NO: 178 with the two following mutations:
replacement of cysteine in position 332 by arginine, and
replacement of asparagine in position 353 by serine.

The mutated netrin 4, represented by the sequence SEQ ID NO: 203, corresponds to mutated netrin 4 represented by SEQ ID NO: 198 wherein amino acids 516 to 618 have been deleted and the mutated netrin 4, represented by the sequence SEQ ID NO: 209, corresponds to mutated netrin 4 represented by SEQ ID NO: 202 wherein amino acids 478 to 618 have been deleted.

The mutated netrin 4 corresponding to protein sequences SEQ ID NO: 192 to SEQ ID NO: 203, as well as the corresponding mutations are represented in the following table:

| Protein sequence | Mutations | Positions of the fragment in the sequence SEQ ID NO: 178 |
|---|---|---|
| SEQ ID NO: 192 | $C^{472} \to Y^{472}$ | 1-628 |
| SEQ ID NO: 193 | $C^{472} \to Y^{472}$ | 1-515 |
| SEQ ID NO: 204 | $C^{472} \to Y^{472}$ | 1-477 |
| SEQ ID NO: 194 | $N^{353} \to S^{353}$ | 1-628 |
| SEQ ID NO: 195 | $N^{353} \to S^{353}$ | 1-515 |
| SEQ ID NO: 205 | $N^{353} \to S^{353}$ | 1-477 |
| SEQ ID NO: 196 | $C^{472} \to Y^{472}; N^{353} \to S^{353}$ | 1-628 |
| SEQ ID NO: 197 | $C^{472} \to Y^{472}; N^{353} \to S^{353}$ | 1-515 |
| SEQ ID NO: 206 | $C^{472} \to Y^{472}; N^{353} \to S^{353}$ | 1-477 |
| SEQ ID NO: 198 | $C^{332} \to K^{332}; C^{472} \to Y^{472}$ | 1-628 |
| SEQ ID NO: 199 | $C^{332} \to K^{332}; C^{472} \to Y^{472}$ | 1-515 |
| SEQ ID NO: 207 | $C^{332} \to K^{332}; C^{472} \to Y^{472}$ | 1-477 |

-continued

| Protein sequence | Mutations | Positions of the fragment in the sequence SEQ ID NO: 178 |
|---|---|---|
| SEQ ID NO: 200 | $C^{332} \to K^{332}$; $C^{472} \to Y^{472}$; $N^{353} \to S^{353}$ | 1-628 |
| SEQ ID NO: 201 | $C^{332} \to K^{332}$; $C^{472} \to Y^{472}$; $N^{353} \to S^{353}$ | 1-515 |
| SEQ ID NO: 208 | $C^{332} \to K^{332}$; $C^{472} \to Y^{472}$; $N^{353} \to S^{353}$ | 1-477 |
| SEQ ID NO: 202 | $N^{353} \to S^{353}$ | 1-628 |
| SEQ ID NO: 203 | $N^{353} \to S^{353}$ | 1-515 |
| SEQ ID NO: 209 | $N^{353} \to S^{353}$ | 1-477 |

The mutated netrin 4 of the invention and the fragments of the invention have an activity of inhibition of the angiogenesis.

The activity of inhibition of the angiogenesis is also called anti-angiogenic activity. This activity can for example be detected in vitro by showing the inhibition of the multiplication, as well as the migration, and the differentiation, of endothelial cells by the above-mentioned mutated proteins or fragments of the invention. Measurement of the inhibition of the endothelial cells multiplication can also be carried out by culturing endothelial cells in the presence of the protein or the fragment, the activity of which is to be tested. Measurement of the inhibition of the endothelial cells migration can also be tested by carrying out a "wound" on a carpet of endothelial cells and by then incubating the cells in the presence of the fragment to be tested. The number of cells that migrated on the wound is then measured. Measurement of the inhibition of the sprouting (tubulogenesis) of the endothelial cells can be carried out by measuring the length of tubules formed by endothelial cells cultured on gel in the presence of the fragment to be tested.

Among the classical models for measuring the angiogenesis, the following one can be cited (models by local administration):
sub-cutaneous injection of Matrigel (Becton Dickinson) impregnated with the compound of the invention (Inoki I, Shiomi T, Hashimoto G, Enomoto H, Nakamura H, Makino K, Ikeda E, Takata S, Kobayashi K, Okada Y (2002) Connective tissue growth factor binds vascular endothelial growth factor (VEGF) and inhibits VEGF-induced angiogenesis. *FASEB J.* 16(2):219-21), or
application to chicken chorio-allantoid membrane of an implant containing a compound of the invention (Plouët J., Schilling J., Gospodarowicz D., *EMBO J.* 1989 Dec. 1; 8(12):3801-6).

Alternatively, the fragments of the invention can be injected by systemic route (intravenous, intra-peritoneal, and subcutaneous route) to animals by which an experimental angiogenic disease was created. The fragments of the invention can also be directly injected into a tumor. Alternatively, the fragments or the anti-idiotypic antibodies of the invention (described hereafter) can be administered by a gene therapy method by local or systemic route by any method allowing the expression of the fragments or of the anti-idiotypic antibodies of the invention. Alternatively, the fragments or the anti-idiotypic antibodies of the invention can be inserted into a plasmid which is transfected into cancer cells. All these measuring methods are in particular described in the article of Jain R K, Schlenger K, Hockel M, Yuan F (1997) Quantitative angiogenesis assays: progress and problems. *Nat. Med.* 3(11):1203-8.

The anti-tumoral activity designates an activity allowing the inhibition of tumor growth and/or the induction of the regression, and even the disappearance of tumors. For example, this activity can be detected in vivo by measuring the tumors mass, the development of which was induced in the mouse by the injection of tumor cells, in the presence and in the absence of the administration of peptide sequences of the invention and/or of nucleic acids that express the peptide sequences of the invention.

The mutated protein of the invention and the fragments of the invention are also characterized in that they have a pericytes activation activity.

This activity of activating the pericytes is in particular checked by the proliferation and migration tests as mentioned hereafter and in particular in the experimental part.

The present invention is in particular based on the fact that the netrins bind to the UNC5H4 receptors of pericytes and smooth muscle cells (SMC).

The present invention also relates to a nucleotide sequence coding for the above-mentioned protein, that is to say a nucleotide sequence coding for the mutated netrin 4.

A preferred nucleotide sequence of the invention is a nucleotide sequence characterized in that it comprises or consists of:
the nucleotide sequence SEQ ID NO: 1 coding for SEQ ID NO: 2, or the nucleotide sequence SEQ ID NO: 3 coding for SEQ ID NO: 4, or
a fragment of one of these nucleotide sequences, represented by one of the sequences SEQ ID NO: 2q-1, q varying from 3 to 36.

The above-mentioned sequences SEQ ID NO: 2q-1 code for the above-mentioned fragments of the mutated netrin 4, represented by SEQ ID NO: 2q, and they correspond to the following nucleotide sequences: SEQ ID NO: 5 coding for SEQ ID NO: 6, SEQ ID NO: 7 coding for SEQ ID NO: 8, SEQ ID NO: 9 coding for SEQ ID NO: 10, SEQ ID NO: 11 coding for SEQ ID NO: 12, SEQ ID NO: 13 coding for SEQ ID NO: 14, SEQ ID NO: 15 coding for SEQ ID NO: 16, SEQ ID NO: 17 coding for SEQ ID NO: 18, SEQ ID NO: 19 coding for SEQ ID NO: 20, SEQ ID NO: 21 coding for SEQ ID NO: 22, SEQ ID NO: 23 coding for SEQ ID NO: 24, SEQ ID NO: 25 coding for SEQ ID NO: 26, SEQ ID NO: 27 coding for SEQ ID NO: 28, SEQ ID NO: 29 coding for SEQ ID NO: 30, SEQ ID NO: 31 coding for SEQ ID NO: 32, SEQ ID NO: 33 coding for SEQ ID NO: 34, SEQ ID NO: 35 coding for SEQ ID NO: 36, SEQ ID NO: 37 coding for SEQ ID NO: 38, SEQ ID NO: 39 coding for SEQ ID NO: 40, SEQ ID NO: 41 coding for SEQ ID NO: 42, SEQ ID NO: 43 coding for SEQ ID NO: 44, SEQ ID NO: 45 coding for SEQ ID NO: 46, SEQ ID NO: 47 coding for SEQ ID NO: 48, SEQ ID NO: 49 coding for SEQ ID NO: 50, SEQ ID NO: 51 coding for SEQ ID NO: 52, SEQ ID NO: 53 coding for SEQ ID NO: 54, SEQ ID NO: 55 coding for SEQ ID NO: 56, SEQ ID NO: 57 coding for SEQ ID NO: 58, SEQ ID NO: 59 coding for SEQ ID NO: 60, SEQ ID NO: 61 coding for SEQ ID NO: 62, SEQ ID NO: 63 coding for SEQ ID NO: 64, SEQ ID NO: 65 coding for SEQ ID NO: 66, SEQ ID NO: 67 coding for SEQ ID NO: 68, SEQ ID NO: 69 coding for SEQ ID NO: 70, and SEQ ID NO: 71 coding for SEQ ID NO: 72.

The present invention relates to a recombinant vector, such as a plasmid, a cosmid, a phage or virus DNA, containing a nucleotide sequence as defined above, said recombinant vector being in particular characterized in that it contains the elements necessary for the expression in a host cell of the polypeptides encoded by the above-mentioned nucleotide sequences, inserted into said vector.

The present invention relates to a host cell, chosen in particular from bacteria, virus, yeasts, fungi cells, plant cells or mammal cells, said host cell being transformed, in particular using a recombinant vector as defined previously.

The present invention also relates to an antibody, characterized in that it is specifically directed against the protein of the invention, as mentioned above.

The present invention also relates to an anti-idiotypic antibody of an antibody as mentioned above.

The present invention also relates to a Fab fragment of the above-mentioned anti-idiotypic antibodies.

The present invention also relates to a pharmaceutical composition comprising as active substance:
- a protein as defined above, or
- a nucleotide sequence as defined above, or
- an antibody as defined above, or
- an anti-idiotypic antibody as defined above, or
- a Fab fragment of anti-idiotypic antibodies as defined above.

The present invention also relates to the use as defined above of the mutated netrin 4, represented by sequence SEQ ID NO: 2 or SEQ ID NO: 4, for the preparation of a drug to be delivered at an amount from about 0.1 to about 2,000 µg/kg, in particular by intravenous, subcutaneous, systemic or intravitreal route, or by local route with infiltrations or a collyrium, and possibly in association with a electropermeation.

The mutated netrin 4 can also be delivered with an injection of a plasmid coding for the mutated netrin-4.

Alternatively, any one of the proteins or fragments of the invention can be delivered by any intravascular device (stents) after the fixation of the protein or the fragment on said device.

The present invention also relates to the use of:
- a protein as defined above, or
- a nucleotide sequence as defined above, or
- an antibody as defined above, or
- an anti-idiotypic antibody as defined above, or
- a Fab fragment of anti-idiotypic antibodies as defined above, for the preparation of a drug for the prevention or treatment of pathologies involving the inhibition of endothelial cell proliferation and/or migration, in particular for the prevention or treatment of pathologies chosen from the group consisting of: cancers and leukaemia, myopia-complicating choroidal neovascularization, cornea neovascularization, in particular graft rejection, glaucoma, diabetic retinopathies or premature retinopathies, rheumatoid arthritis, psoriasis arthritis, angioma, angiosarcoma, Castleman's disease, and Kaposi's sarcoma, or for the treatment of obesity or retinal neovascularization.

The expression "inhibition of endothelial cell proliferation" designates any substance able to slow down the proliferation of endothelial cells according to the proliferation test as described hereafter.

In one preferred embodiment, the present invention relates to the use of:
a protein chosen among the group consisting in the mutated netrin 4, represented by the sequence SEQ ID NO: 2, or mutated netrin 4 represented by the sequence SEQ ID NO: 4, or a fragment of the mutated netrin 4 corresponding to protein sequences SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ SEQ ID NO: 46, SEQ ID NO: 48, SEQ ID NO: 50, SEQ ID NO: 52, SEQ ID NO: 54, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 194, SEQ ID NO: 196, SEQ ID NO: 198, SEQ ID NO: 200 and SEQ ID NO: 202, or a nucleotide sequence chosen among the group consisting in SEQ ID NO: 1 coding for SEQ ID NO: 2, or the nucleotide coding for sequence SEQ ID NO: 3 coding for SEQ ID NO: 4, or a nucleic acid sequence coding for a fragment of the mutated netrin 4 chosen among the group consisting in: SEQ ID NO: 11 coding for SEQ ID NO: 12, SEQ ID NO: 13 coding for SEQ ID NO: 14, SEQ ID NO: 15 coding for SEQ ID NO: 16, SEQ ID NO: 17 coding for SEQ ID NO: 18, SEQ ID NO: 19 coding for SEQ ID NO: 20, SEQ ID NO: 21 coding for SEQ ID NO: 22, SEQ ID NO: 23 coding for SEQ ID NO: 24, SEQ ID NO: 25 coding for SEQ ID NO: 26, SEQ ID NO: 27 coding for SEQ ID NO: 28, SEQ ID NO: 29 coding for SEQ ID NO: 30, SEQ ID NO: 31 coding for SEQ ID NO: 32, SEQ ID NO: 33 coding for SEQ ID NO: 34, SEQ ID NO: 35 coding for SEQ ID NO: 36, SEQ ID NO: 37 coding for SEQ ID NO: 38, SEQ ID NO: 39 coding for SEQ ID NO: 40, SEQ ID NO: 41 coding for SEQ ID NO: 42, SEQ ID NO: 43 coding for SEQ ID NO: 44, SEQ ID NO: 45 coding for SEQ ID NO: 46, SEQ ID NO: 47 coding for SEQ ID NO: 48, SEQ ID NO: 49 coding for SEQ ID NO: 50, SEQ ID NO: 51 coding for SEQ ID NO: 52, SEQ ID NO: 53 coding for SEQ ID NO: 54, SEQ ID NO: 57 coding for SEQ ID NO: 58, SEQ ID NO: 59 coding for SEQ ID NO: 60, SEQ ID NO: 61 coding for SEQ ID NO: 62, SEQ ID NO: 63 coding for SEQ ID NO: 64, SEQ ID NO: 65 coding for SEQ ID NO: 66, SEQ ID NO: 67 coding for SEQ ID NO: 68, SEQ ID NO: 69 coding for SEQ ID NO: 70, and SEQ ID NO: 71 coding for SEQ ID NO: 72, or antibody characterized in that it is specifically directed against a protein mentioned above, or an anti-idiotypic antibody characterized in that it is specifically directed against an antibody mentioned above, or a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: cancers and leukaemia, in particular angioma, angio sarcoma, Castleman's disease, Kaposi's sarcoma and rheumatoid arthritis.

In one other preferred embodiment, the present invention relates to the use of:
a protein chosen among the group consisting in the mutated netrin 4, represented by the sequence SEQ ID NO: 2, or mutated netrin 4 represented by the sequence SEQ ID NO: 4, or a fragment of the mutated netrin 4 corresponding to protein sequences SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44, SEQ SEQ ID NO: 46, SEQ ID NO: 48, SEQ ID NO: 50, SEQ ID NO: 52, SEQ ID NO: 54, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 192, SEQ ID NO: 194, SEQ ID NO: 196, SEQ ID NO: 198, SEQ ID NO: 200 and SEQ ID NO: 202, or a nucleotide sequence chosen among the group consisting in SEQ ID NO: 1 coding for SEQ ID NO: 2, or the nucleotide coding for sequence SEQ ID NO: 3 coding for SEQ ID NO: 4, or a nucleic acid sequence coding for a fragment of the mutated netrin 4 chosen among the group consisting in: SEQ ID NO: 11 coding for SEQ ID NO: 12, SEQ ID NO: 13 coding for SEQ ID NO: 14, SEQ ID NO: 15 coding for SEQ ID NO: 16, SEQ ID NO: 17 coding for SEQ ID NO: 18, SEQ ID NO: 19 coding for SEQ ID NO: 20, SEQ ID NO: 21 coding for SEQ ID NO: 22, SEQ ID NO: 23 coding for SEQ ID NO: 24, SEQ ID NO: 25 coding for SEQ ID NO: 26, SEQ ID NO: 27 coding for SEQ ID NO: 28, SEQ ID NO: 29 coding for SEQ ID NO: 30, SEQ ID NO: 31 coding for SEQ ID NO: 32, SEQ ID NO: 33 coding for SEQ ID NO: 34, SEQ ID NO: 35 coding for SEQ ID NO: 36, SEQ ID NO: 37 coding for SEQ ID NO: 38, SEQ ID NO: 39 coding for SEQ ID NO: 40, SEQ ID NO: 41 coding for SEQ ID NO: 42, SEQ ID NO: 43 coding for SEQ ID NO: 44, SEQ ID NO: 45 coding for SEQ ID NO: 46, SEQ ID NO: 47 coding for SEQ ID NO: 48, SEQ ID NO: 49 coding for SEQ ID NO: 50, SEQ ID NO: 51 coding for SEQ ID NO: 52, SEQ ID NO: 53 coding for SEQ ID NO: 54, SEQ ID NO: 57 coding for SEQ ID NO: 58, SEQ ID NO: 59 coding for SEQ ID NO: 60, SEQ ID NO: 61 coding for SEQ ID NO: 62, SEQ ID NO: 63 coding for SEQ ID NO: 64, SEQ ID NO: 65 coding for SEQ ID NO: 66, SEQ ID NO: 67 coding for SEQ ID NO: 68, SEQ ID NO: 69 coding for SEQ ID NO: 70, and SEQ ID NO: 71 coding for SEQ ID NO: 72, or an antibody characterized in that it is specifically directed against a protein mentioned above, or an anti-idiotypic antibody characterized in that it is specifically directed against an antibody mentioned above, or a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: myopia-complicating choroidal neovascularization, cornea neovascularization, in particular graft rejection, glaucoma, diabetic retinopathies or premature retinopathies, psoriasis arthritis, or for the treatment of obesity or retinal neovascularization.

In one other preferred embodiment, the present invention relates to the use of:

a protein chosen among the group consisting in the mutated netrin 4, represented by the sequence SEQ ID NO: 2, or mutated netrin 4 represented by the sequence SEQ ID NO: 4, or a fragment of the mutated netrin 4 corresponding to protein sequences SEQ ID NO: 6, SEQ ID NO: 8, SEQ ID NO: 10, SEQ ID NO: 56, SEQ ID NO: 193, SEQ ID NO: 195, SEQ ID NO: 197, SEQ ID NO: 199, SEQ ID NO: 201, SEQ ID NO: 203, SEQ ID NO: 204, SEQ ID NO: 205, SEQ ID NO: 206, SEQ ID NO: 207, SEQ ID NO: 208 and SEQ ID NO: 209, or a nucleotide sequence chosen among the group consisting in SEQ ID NO: 1 coding for SEQ ID NO: 2, or the nucleotide coding for sequence SEQ ID NO: 3 coding for SEQ ID NO: 4, or a nucleic acid sequence coding for a fragment of the mutated netrin 4 chosen among the group consisting in: SEQ ID NO: 5 coding for SEQ ID NO: 6, SEQ ID NO: 7 coding for SEQ ID NO: 8, SEQ ID NO: 9 coding for SEQ ID NO: 10 and SEQ ID NO: 55 coding for SEQ ID NO: 56, or an antibody characterized in that it is specifically directed against a protein mentioned above, or an anti-idiotypic antibody characterized in that it is specifically directed against an antibody mentioned above, or a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: myopia-complicating choroidal neovascularization, cornea neovascularization, in particular graft rejection, glaucoma, diabetic retinopathies or premature retinopathies, psoriasis arthritis, or for the treatment of obesity or retinal neovascularization.

The present invention also relates to the use of:

an antibody as defined above, or a Fab fragment of anti-idiotypic antibodies as defined above, for the preparation of a drug for the prevention or treatment of pathologies involving the stimulation of endothelial cell proliferation and/or migration, in particular for the prevention or treatment of pathologies chosen from the group consisting of: ischemic pathologies such as arteritis of lower limbs, myocardium infarct, cerebral vascular accidents, scleroderma, and Raynaud's disease.

Measurement of the activation of the endothelial cells proliferation can be carried out by placing the endothelial cells in an appropriate culture medium and by then measuring the total number of cells.

Measurement of the activation of the endothelial cells migration can be carried out by making a "wound" on a carpet of endothelial cells and then incubating the cells in the presence of the protein, the nucleotide sequence or the anti-idiotypic antibody to be tested. The number of cells having migrated onto the wound is then measured.

The present invention also relates to the use of:

a protein as defined above, or a nucleotide sequence as defined above, or an antibody as defined above, or an anti-idiotypic antibody as defined above, or a Fab fragment of anti-idiotypic antibodies as defined above, for the preparation of a drug for the prevention or treatment of non-tumoral pathologies linked to or caused by a pericyte or smooth muscular cell rarefaction, and requiring an activation of pericyte or smooth muscular cell proliferation or migration, said non-tumoral pathologies being in particular chosen from the group consisting of:

age-related macular degeneration, neovascular glaucoma, psoriasis, atherosclerosis, intestinal malformations, Crohn's disease, vascular or sub-cortical vascular dementia, Alzheimer's disease, bone degenerative pathologies, and fractures, and aneurysms, and vascular dissections.

The present invention also relates to the use as defined above, characterized in that the activity of activation of pericytes or smooth muscular cell proliferation or migration is measured according to the proliferation or migration test, and in that this activity of activation corresponds to at least 120% of the cells obtained in the absence of the protein, the nucleotide sequence, the antibody, the anti-idiotypic antibody or the Fab fragment of anti-idiotypic antibodies as defined above.

Measurement of the activation of the migration of pericytes or smooth muscular cells can be carried out by making a "wound" on a carpet of cells and then incubating the cells in the presence of the protein, the nucleotide sequence, the antibody, the anti-idiotypic antibody or the Fab fragment to be tested. The number of cells having migrated onto the wound is then measured.

Measurement of the activation of the proliferation of pericyte or smooth muscular cells can be carried out by placing the pericytes or smooth muscular cells in an appropriate culture medium, in particular in DMEM medium that does not contain any serum, and by measuring the total number of cells.

The present invention also relates to the use of:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36,
the protein represented by one of the sequences chosen among SEQ ID NO:185 or SEQ ID NO: 209,
in association with a chemotherapy agent, for the preparation of a drug for the treatment of cancers.

The present invention also relates to a pharmaceutical composition comprising a chemotherapy agent, in association with the protein represented by SEQ ID NO: 2 or SEQ ID NO: 4, or in association with a fragment of said sequence SEQ ID NO: 2 or SEQ ID NO: 4, represented by one of the sequences SEQ ID NO: 2q, q varying from 3 to 36,
said chemotherapy agent being in particular chosen from the group consisting of: doxorubicin, methotrexate, vinblastine, vincristine, cladribine, fluorouracil, cytarabine, anthracyclines, cisplatin, cyclophosphamide, fludarabine, gemcitabine, aromatase inhibitors, irinotecan, navelbine, oxaliplatin, taxol, and docetaxel.

The combination of an anti-angiogenic agent with a chemotherapy agent allows the obtaining of a synergic effect and the induction of a reduced resistance to the usual anti-tumoral treatments.

The present invention also relates to the use of:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36,
the protein represented by one of the sequences chosen among SEQ ID NO:185 or SEQ ID NO: 209,
in association with an anti-angiogenic agent chosen in particular from the group consisting of: AVASTIN (bevacizumab) manufactured by Genentech and Roche, MACUGEN (pegaptanib) manufactured by Eyetech and Pfizer, and LUCENTIS (ranibizumab) manufactured by Genentech and Novartis, or any other anti-VEGF agent, such as Sutent (Pfizer) or Sorafenib,), humanized antibodies against neuropiline-1 or any other anti-VEGF agent or any other anti-VEGF agent, such as SUTENT (sunitinib) or NEXAVAR (Sorafenib) as well as humanized antibodies against DLL4 or agents interfering with the angiopoietins pathways such as AM 386,
for the preparation of a drug for the prevention or treatment of tumoral or non-tumoral pathologies as defined above.

In the present invention, the doses of the mutated netrin-4 vary from about 10 to about 10,000 ng/injection, in particular from about 100 to about 5,000 ng/injection, every 6 weeks.

In the present invention, the doses of the anti-angiogenic agent (AVASTIN, MACUGEN or LUCENTIS for example) vary from about 0.3 to about 1 mg every 6 weeks.

The present invention also relates to a combination product comprising:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36,
the protein represented by one of the sequences chosen among SEQ ID NO:185 or SEQ ID NO: 209,
with an anti-angiogenic agent chosen in particular from the group consisting of: AVASTIN (bevacizumab), MACUGEN (pegaptanib), and LUCENTIS (ranibizumab), or any other anti-VEGF agent,), humanized antibodies against neuropiline-1 or any other anti-VEGF agent or any other anti-VEGF agent, such as SUTENT (sunitinib) or NEXAVAR (Sorafenib) as well as humanized antibodies against DLL4 or agents interfering with the angiopoietins pathways such as AM 386,
for a simultaneous, separated or sequential use for the treatment or prevention of tumoral or non-tumoral pathologies as defined above.

The present invention also relates to a protein comprising or consisting of: SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, and SEQ ID NO: 176.

SEQ ID NO: 74 corresponds to a peptide construction comprising the signal peptide of native netrin 4 SEQ ID NO: 178, said signal peptide corresponding to the 19 first amino acids of said native netrin 4, and the fragment SEQ ID NO: 56.

SEQ ID NO: 76 corresponds to a peptide construction comprising the signal peptide of native netrin 4 SEQ ID NO: 178, and the fragment SEQ ID NO: 58.

SEQ ID NO: 78 corresponds to a peptide construction comprising the signal peptide of native netrin 4 SEQ ID NO: 178, and the fragment SEQ ID NO: 60.

SEQ ID NO: 80 corresponds to a peptide construction comprising the signal peptide of native netrin 4 SEQ ID NO: 178, and the fragment SEQ ID NO: 62.

SEQ ID NO: 82 corresponds to a peptide construction comprising the signal peptide of native netrin 4 SEQ ID NO: 178, and the fragment SEQ ID NO: 64.

SEQ ID NO: 84 corresponds to a peptide construction comprising the signal peptide of native netrin 4 SEQ ID NO: 178, and the fragment SEQ ID NO: 66.

SEQ ID NO: 86 corresponds to a peptide construction comprising the signal peptide of native netrin 4 SEQ ID NO: 178, and the fragment SEQ ID NO: 68.

SEQ ID NO: 88 corresponds to a peptide construction comprising the signal peptide of native netrin 4 SEQ ID NO: 178, and the fragment SEQ ID NO: 70.

SEQ ID NO: 90 corresponds to a peptide construction comprising the signal peptide of native netrin 4 SEQ ID NO: 178, and the fragment SEQ ID NO: 72.

SEQ ID NO: 92 corresponds to a peptide construction comprising the signal peptide of native netrin 4 SEQ ID NO: 178, and the fragment of the protein SEQ ID NO: 182 from residue 20 to residue 515.

SEQ ID NO: 94 corresponds to a peptide construction comprising the signal peptide of SEQ ID NO: 178, and the fragments of the protein SEQ ID NO: 182 from residue 20 to residue 260, and from residue 516 to residue 628.

SEQ ID NO: 96 corresponds to a peptide construction comprising the signal peptide of SEQ ID NO: 178, and the fragments of the protein SEQ ID NO: 182 from residue 20 to residue 320, and from residue 516 to residue 628.

SEQ ID NO: 98 corresponds to a peptide construction comprising the signal peptide of native netrin 4 SEQ ID NO: 178, and the fragments of the protein SEQ ID NO: 182 from residue 20 to residue 260, from residue 332 to residue 387, and from residue 516 to residue 628.

SEQ ID NO: 100 corresponds to a peptide construction comprising the signal peptide of native netrin 4 SEQ ID NO: 178, and the fragments of the protein SEQ ID NO: 182 from residue 20 to residue 260, from residue 394 to residue 445, and from residue 516 to residue 628.

SEQ ID NO: 102 corresponds to a peptide construction comprising the signal peptide of native netrin 4 SEQ ID NO: 178, and the fragments of the protein SEQ ID NO: 182 from residue 20 to residue 320, from residue 332 to residue 387, and from residue 516 to residue 628.

SEQ ID NO: 104 corresponds to a peptide construction comprising the signal peptide of native netrin 4 SEQ ID NO: 178, and the fragments of the protein SEQ ID NO: 182 from residue 20 to residue 260, from residue 332 to residue 387, from residue 394 to residue 445, and from residue 516 to residue 628.

SEQ ID NO: 106 corresponds to a peptide construction comprising the signal peptide of native netrin 4 SEQ ID NO: 178, and the fragments of the protein SEQ ID NO: 182 from residue 20 to residue 320, from residue 394 to residue 445, and from residue 516 to residue 628.

SEQ ID NO: 108 corresponds to a peptide construction comprising the signal peptide of native netrin 4 SEQ ID NO: 178, and the fragments of the protein SEQ ID NO: 182 from residue 20 to residue 320, from residue 332 to residue 387, from residue 394 to residue 445, and from residue 516 to residue 628.

SEQ ID NO: 110 corresponds to a peptide construction comprising the signal peptide of SEQ ID NO: 178, and the protein sequence SEQ ID NO: 4.

SEQ ID NO: 112 corresponds to a peptide construction comprising the signal peptide of SEQ ID NO: 178, and the protein sequence SEQ ID NO: 184.

SEQ ID NO: 114 corresponds to a peptide construction comprising the signal peptide of SEQ ID NO: 178, and the fragment SEQ ID NO: 6.

SEQ ID NO: 116 corresponds to a peptide construction comprising the signal peptide of SEQ ID NO: 178, and the fragment SEQ ID NO: 10.

SEQ ID NO: 118 corresponds to a peptide construction comprising the signal peptide of SEQ ID NO: 178, and the fragment SEQ ID NO: 12.

SEQ ID NO: 120 corresponds to a peptide construction comprising the signal peptide of SEQ ID NO: 178, and the fragment SEQ ID NO: 16.

SEQ ID NO: 122 corresponds to a peptide construction comprising the signal peptide of SEQ ID NO: 178, and the fragment SEQ ID NO: 18.

SEQ ID NO: 124 corresponds to a peptide construction comprising the signal peptide of SEQ ID NO: 178, and the fragment SEQ ID NO: 20.

SEQ ID NO: 126 corresponds to a peptide construction comprising the signal peptide of SEQ ID NO: 178, and the fragment SEQ ID NO: 22.

SEQ ID NO: 128 corresponds to a peptide construction comprising the signal peptide of SEQ ID NO: 178, and the fragment SEQ ID NO: 24.

SEQ ID NO: 130 corresponds to a peptide construction comprising the signal peptide of SEQ ID NO: 178, and the fragment SEQ ID NO: 26.

SEQ ID NO: 132 corresponds to a peptide construction comprising the signal peptide of SEQ ID NO: 178, and the fragment SEQ ID NO: 34.

SEQ ID NO: 134 corresponds to a peptide construction comprising the signal peptide of SEQ ID NO: 178, and the fragment SEQ ID NO: 36.

SEQ ID NO: 136 corresponds to a peptide construction comprising the signal peptide of SEQ ID NO: 178, and the fragment SEQ ID NO: 38.

SEQ ID NO: 138 corresponds to a peptide construction comprising the signal peptide of SEQ ID NO: 178, and the fragment SEQ ID NO: 46.

SEQ ID NO: 140 corresponds to a peptide construction comprising the signal peptide of SEQ ID NO: 178, and the fragment SEQ ID NO: 48.

SEQ ID NO: 142 corresponds to a peptide construction comprising the signal peptide of SEQ ID NO: 178, and the fragment SEQ ID NO: 50.

SEQ ID NO: 144 corresponds to a peptide construction comprising the signal peptide of SEQ ID NO: 178, and the fragment SEQ ID NO: 54.

SEQ ID NO: 146 corresponds to a peptide construction comprising the signal peptide of SEQ ID NO: 178, and the fragment of the protein SEQ ID NO: 182 from residue 261 to residue 515.

SEQ ID NO: 148 corresponds to a peptide construction comprising the signal peptide of SEQ ID NO: 178, and the fragment of the protein SEQ ID NO: 182 from residue 32 to residue 515.

SEQ ID NO: 150 corresponds to a peptide construction comprising the signal peptide of SEQ ID NO: 178, and the fragment of the protein SEQ ID NO: 182 from residue 32 to residue 628.

SEQ ID NO: 152 corresponds to a peptide construction comprising the signal peptide of SEQ ID NO: 178, and the fragment of the protein SEQ ID NO: 182 from residue 261 to residue 628.

SEQ ID NO: 154 corresponds to a peptide construction comprising the signal peptide of SEQ ID NO: 178, and the fragments of the protein SEQ ID NO: 182 from residue 332 to residue 387, and from residue 516 to residue 628.

SEQ ID NO: 156 corresponds to a peptide construction comprising the signal peptide of SEQ ID NO: 178, and the fragments of the protein SEQ ID NO: 182 from residue 32 to residue 260, and from residue 516 to residue 628.

SEQ ID NO: 158 corresponds to a peptide construction comprising the signal peptide of SEQ ID NO: 178, and the fragments of the protein SEQ ID NO: 182 from residue 32 to residue 320, and from residue 516 to residue 628.

SEQ ID NO: 160 corresponds to a peptide construction comprising the signal peptide of SEQ ID NO: 178, and the fragments of the protein SEQ ID NO: 182 from residue 32 to residue 260, from residue 332 to residue 387, and from residue 516 to residue 628.

SEQ ID NO: 162 corresponds to a peptide construction comprising the signal peptide of SEQ ID NO: 178, and the fragments of the protein SEQ ID NO: 182 from residue 32 to residue 260, from residue 394 to residue 445, and from residue 516 to residue 628.

SEQ ID NO: 164 corresponds to a peptide construction comprising the signal peptide of SEQ ID NO: 178, and the fragments of the protein SEQ ID NO: 182 from residue 261 to residue 320, from residue 332 to residue 387, and from residue 516 to residue 628.

SEQ ID NO: 166 corresponds to a peptide construction comprising the signal peptide of SEQ ID NO: 178, and the fragments of the protein SEQ ID NO: 182 from residue 332 to residue 387, from residue 394 to residue 445, and from residue 516 to residue 628.

SEQ ID NO: 168 corresponds to a peptide construction comprising the signal peptide of SEQ ID NO: 178, and the fragments of the protein SEQ ID NO: 182 from residue 261 to residue 320, from residue 332 to residue 387, from residue 394 to residue 445, and from residue 516 to residue 628.

SEQ ID NO: 170 corresponds to a peptide construction comprising the signal peptide of SEQ ID NO: 178, and the fragments of the protein SEQ ID NO: 182 from residue 32 to residue 320, from residue 332 to residue 387, and from residue 516 to residue 628.

SEQ ID NO: 172 corresponds to a peptide construction comprising the signal peptide of SEQ ID NO: 178, and the fragments of the protein SEQ ID NO: 182 from residue 32 to residue 260, from residue 332 to residue 387, from residue 394 to residue 445, and from residue 516 to residue 628.

SEQ ID NO: 174 corresponds to a peptide construction comprising the signal peptide of SEQ ID NO: 178, and the fragments of the protein SEQ ID NO: 182 from residue 32 to residue 320, from residue 394 to residue 445, and from residue 516 to residue 628.

SEQ ID NO: 176 corresponds to a peptide construction comprising the signal peptide of SEQ ID NO: 178, and the fragments of the protein SEQ ID NO: 182 from residue 32 to residue 320, from residue 332 to residue 387, from residue 394 to residue 445, and from residue 516 to residue 628.

The present invention also relates to the use of:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36, or
the protein represented by one of the sequences chosen among SEQ ID NO:192 or SEQ ID NO: 209,
to select, differentiate and/or expand pericytes or smooth muscular cells from any sampling of progenitor cells or stem cells for cell therapy.

The present invention also relates to the use of:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36, or
the protein represented by one of the sequences chosen among SEQ ID NO:192 or SEQ ID NO: 209,
in combination with pericytes or vascular smooth muscle cells differentiated as mentioned above to maturate tumoral vascularization and therefore inhibiting cancer progression.

The present invention also relates to the use of:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36, or
the protein represented by one of the sequences chosen among SEQ ID NO:192 or SEQ ID NO: 209,
in association with pericytes or vascular smooth muscle cells, for the preparation of a drug for the treatment of cancers.

The present invention also relates to a pharmaceutical composition comprising pericytes or vascular smooth muscle cells, in association with the protein represented by SEQ ID NO: 2 or SEQ ID NO: 4, or in association with a fragment of said sequence SEQ ID NO: 2 or SEQ ID NO: 4, represented by one of the sequences SEQ ID NO: 2q, q varying from 3 to 36, or in association with one of the sequences SEQ ID NO:185 to SEQ ID NO:209.

The present invention also relates to a combination product comprising:
the protein represented by SEQ ID NO: 2 or SEQ ID NO: 4, or
a fragment of said sequence SEQ ID NO: 2 or SEQ ID NO: 4, represented by one of the sequences SEQ ID NO: 2q, q varying from 3 to 36, or
the protein represented by one of the sequences chosen among SEQ ID NO:192 or SEQ ID NO: 209,
with pericytes or vascular smooth muscle cells,
for a simultaneous, separated or sequential use for the treatment of cancers.

The present invention also relates to the use of:
a protein comprising or consisting of SEQ ID NO 2q, q varying from 37 to 88,
or
a nucleotide sequence, represented by one of the sequences SEQ ID NO: 2q-1, q varying from 37 to 88, or
an antibody characterized in that it is specifically directed against a protein mentioned above, or
an anti-idiotypic antibody characterized in that it is specifically directed against an antibody mentioned above, or
a Fab fragment of anti-idiotypic antibodies characterized in that it is specifically directed against an antibody mentioned above,
for the preparation of a drug for the prevention or treatment of pathologies involving the inhibition of endothelial cell proliferation and/or migration, in particular for the prevention or treatment of pathologies chosen from the group consisting of: cancers and leukaemia, myopia-complicating choroidal neovascularization, cornea neovascularization, in particular graft rejection, glaucoma, diabetic retinopathies or premature retinopathies, rheumatoid arthritis, psoriasis arthritis, angioma, angiosarcoma, Castleman's disease, and Kaposi's sarcoma, or for the treatment of obesity or retinal neovascularization.

The above-mentioned sequences SEQ ID NO: 2q correspond to protein sequences SEQ ID NO: 74 to 88, and thus are the following protein sequences: SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, and SEQ ID NO: 176.

The above-mentioned sequences SEQ ID NO: 2q-1 code for the above-mentioned mutated netrin 4, represented by SEQ ID NO: 2q, and they correspond to the following nucleotide sequences: SEQ ID NO: 73, SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, and SEQ ID NO: 175.

In one preferred embodiment, the invention relates to the use of:
- a protein comprising or consisting of SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, or
- a nucleotide sequence comprising or consisting of: SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, or
- an anti-idiotypic antibody characterized in that it is specifically directed against an antibody mentioned above, or
- a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: cancers and leukaemia, in particular angioma, angiosarcoma, Castleman's disease, Kaposi's sarcoma and rheumatoid arthritis.

In another preferred embodiment, the invention relates to the use of:
- a protein comprising or consisting of SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, or
- a nucleotide sequence comprising or consisting of: SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 93, SEQ ID NO: 95, SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 149, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, or
- an anti-idiotypic antibody characterized in that it is specifically directed against an antibody mentioned above, or
- a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: myopia-complicating choroidal neovascularization, cornea neovascularization, in particular graft rejection, glaucoma, diabetic retinopathies or premature retinopathies, psoriasis arthritis, or for the treatment of obesity or retinal neovascularization.

In another preferred embodiment, the invention relates to the use of:
- a protein comprising or consisting of SEQ ID NO: 74, SEQ ID NO: 92, SEQ ID NO: 114, SEQ ID NO: 116, SEQ ID NO: 146, SEQ ID NO: 148, or a nucleotide sequence comprising or consisting of: SEQ ID NO: 73, SEQ ID NO: 91, SEQ ID NO: 113, SEQ ID NO: 115, SEQ ID NO: 145, SEQ ID NO: 147, or an anti-idiotypic antibody characterized in that it is specifically directed against an antibody mentioned above, or a Fab fragment of anti-idiotypic antibodies characterized in that it is specifically directed against an antibody mentioned above, for the preparation of a drug for the prevention or treatment of pathologies involving the inhibition of endothelial cell proliferation and/or migration, in particular for the prevention or treatment of pathologies chosen from the group consisting of: myopia-complicating choroidal neovascularization, cornea neovascularization, in particular graft rejection, glaucoma, diabetic retinopathies or premature retinopathies, psoriasis arthritis, or for the treatment of obesity or retinal neovascularization.

| Proteins | Protein sequence | Nucleotide sequence |
| --- | --- | --- |
| Native netrin 4 (with signal peptide)(1-628) | SEQ ID NO: 178 | SEQ ID NO: 177 |
| Native netrin 4 (without signal peptide)(20-628) | SEQ ID NO: 180 | SEQ ID NO: 179 |
| Mutated netrin 4 (with signal peptide)(1-628) | SEQ ID NO: 182 | SEQ ID NO: 181 |
| Mutated netrin 4 (without signal peptide)(20-628) | SEQ ID NO: 184 | SEQ ID NO: 183 |
| Mutated netrin 4 of the invention (with signal peptide)(1-628) | SEQ ID NO: 2 | SEQ ID NO: 1 |
| Mutated netrin 4 of the invention (without signal peptide)(20-628) | SEQ ID NO: 4 | SEQ ID NO: 3 |

| Substitution mutant proteins | Protein sequence | Nucleotide sequence |
| --- | --- | --- |
| Mutated netrin 4 of the invention (with signal peptide)(1-628): sNET4-m 1 | SEQ ID NO: 185 | — |
| Mutated netrin 4 of the invention (with signal peptide)(1-628): sNET4-m 2 | SEQ ID NO: 186 | — |
| Mutated netrin 4 of the invention (with signal peptide)(1-628): sNET4-m 3 | SEQ ID NO: 187 | — |
| Mutated netrin 4 of the invention (with signal peptide)(1-628): sNET4-m 4 | SEQ ID NO: 188 | — |
| Mutated netrin 4 of the invention (with signal peptide)(1-628): sNET4-m 5 | SEQ ID NO: 189 | — |
| Mutated netrin 4 of the invention (with signal peptide)(1-628): sNET4-m 6 | SEQ ID NO: 190 | — |
| Mutated netrin 4 of the invention (with signal peptide)(1-628): sNET4-m 7 | SEQ ID NO: 191 | — |
| Mutated netrin 4 of the invention (with signal peptide)(1-628) | SEQ ID NO: 192 | — |
| Mutated netrin 4 of the invention Delta C (with signal peptide)(1-515) | SEQ ID NO: 193 | — |
| Mutated netrin 4 of the invention (with signal peptide)(1-628) | SEQ ID NO: 194 | — |
| Mutated netrin 4 of the invention Delta C (with signal peptide)(1-515) | SEQ ID NO: 195 | — |
| Mutated netrin 4 of the invention (with signal peptide)(1-628) | SEQ ID NO: 196 | — |
| Mutated netrin 4 of the invention Delta C (with signal peptide)(1-515) | SEQ ID NO: 197 | — |
| Mutated netrin 4 of the invention (with signal peptide)(1-628) | SEQ ID NO: 198 | — |
| Mutated netrin 4 of the invention Delta C (with signal peptide)(1-515) | SEQ ID NO: 199 | — |
| Mutated netrin 4 of the invention (with signal peptide)(1-628) | SEQ ID NO: 200 | — |
| Mutated netrin 4 of the invention Delta C (with signal peptide)(1-515) | SEQ ID NO: 201 | — |
| Mutated netrin 4 of the invention (with signal peptide)(1-628) | SEQ ID NO: 202 | — |
| Mutated netrin 4 of the invention Delta C (with signal peptide)(1-477) | SEQ ID NO: 203 | — |
| Mutated netrin 4 of the invention Delta C (with signal peptide)(1-477) | SEQ ID NO: 204 | — |
| Mutated netrin 4 of the invention Delta C (with signal peptide)(1-477) | SEQ ID NO: 205 | — |
| Mutated netrin 4 of the invention Delta C (with signal peptide)(1-477) | SEQ ID NO: 206 | — |
| Mutated netrin 4 of the invention Delta C (with signal peptide)(1-477) | SEQ ID NO: 207 | — |
| Mutated netrin 4 of the invention Delta C (with signal peptide)(1-477) | SEQ ID NO: 208 | — |
| Mutated netrin 4 of the invention Delta C (with signal peptide)(1-477) | SEQ ID NO: 209 | — |

| Fragments of mutated netrin 4 | Protein sequence | Nucleotide sequence |
| --- | --- | --- |
| 261-515 | SEQ ID NO: 6 | SEQ ID NO: 5 |
| 1-515 | SEQ ID NO: 8 | SEQ ID NO: 7 |
| 32-515 | SEQ ID NO: 10 | SEQ ID NO: 9 |
| 32-628 | SEQ ID NO: 12 | SEQ ID NO: 11 |
| 1-260 + 516-628 | SEQ ID NO: 14 | SEQ ID NO: 13 |
| 261-628 | SEQ ID NO: 16 | SEQ ID NO: 15 |
| 332-387 + 516-628 | SEQ ID NO: 18 | SEQ ID NO: 17 |
| 32-260 + 516-628 | SEQ ID NO: 20 | SEQ ID NO: 19 |
| 32-260 + 261-320 + 516-628 | SEQ ID NO: 22 | SEQ ID NO: 21 |
| 32-260 + 332-387 + 516-628 | SEQ ID NO: 24 | SEQ ID NO: 23 |
| 32-260 + 394-445 + 516-628 | SEQ ID NO: 26 | SEQ ID NO: 25 |
| 1-260 + 261-320 + 516-628 | SEQ ID NO: 28 | SEQ ID NO: 27 |
| 1-260 + 332-387 + 516-628 | SEQ ID NO: 30 | SEQ ID NO: 29 |
| 1-260 + 394-445 + 516-628 | SEQ ID NO: 32 | SEQ ID NO: 31 |
| 261-320 + 332-387 + 516-628 | SEQ ID NO: 34 | SEQ ID NO: 33 |
| 332-387 + 394-445 + 516-628 | SEQ ID NO: 36 | SEQ ID NO: 35 |
| 261-320 + 332-387 + 394-445 + 516-628 | SEQ ID NO: 38 | SEQ ID NO: 37 |
| 1-260 + 261-320 + 332-387 + 516-628 | SEQ ID NO: 40 | SEQ ID NO: 39 |
| 1-260 + 332-387 + 394-445 + 516-628 | SEQ ID NO: 42 | SEQ ID NO: 41 |
| 1-260 + 261-320 + 394-445 + 516-628 | SEQ ID NO: 44 | SEQ ID NO: 43 |
| 32-260 + 261-320 + 332-387 + 516-628 | SEQ ID NO: 46 | SEQ ID NO: 45 |
| 32-260 + 332-387 + 394-445 + 516-628 | SEQ ID NO: 48 | SEQ ID NO: 47 |
| 32-260 + 261-320 + 394-445 + 516-628 | SEQ ID NO: 50 | SEQ ID NO: 49 |
| 1-260 + 261-320 + 332-387 + 394-445 + 516-628 | SEQ ID NO: 52 | SEQ ID NO: 51 |
| 32-260 + 261-320 + 332-387 + 394-445 + 516-628 | SEQ ID NO: 54 | SEQ ID NO: 53 |
| 20-516 | SEQ ID NO: 56 | SEQ ID NO: 55 |
| 20-260 + 516-628 | SEQ ID NO: 58 | SEQ ID NO: 57 |
| 20-260 + 261-320 + 516-628 | SEQ ID NO: 60 | SEQ ID NO: 59 |
| 20-260 + 332-387 + 516-628 | SEQ ID NO: 62 | SEQ ID NO: 61 |
| 20-260 + 394-445 + 516-628 | SEQ ID NO: 64 | SEQ ID NO: 63 |
| 20-260 + 261-320 + 332-387 + 516-628 | SEQ ID NO: 66 | SEQ ID NO: 65 |
| 20-260 + 332-387 + 394-445 + 516-628 | SEQ ID NO: 68 | SEQ ID NO: 67 |
| 20-260 + 261-320 + 394-445 + 516-628 | SEQ ID NO: 70 | SEQ ID NO: 69 |
| 20-260 + 261-320 + 332-387 + 394-445 + 516-628 | SEQ ID NO: 72 | SEQ ID NO: 71 |

FIGURES

FIG. 1A corresponds to a proliferation test of smooth muscular cells from aorta. The x-axis represents the concentration in ng/ml of the protein netrin 4 or of the mutated netrin 4 of the invention and the y-axis represents the proliferation percentage. The left curve with black circles corresponds to the mutated netrin 4, and the right curve with black triangles corresponds to the native netrin 4.

FIG. 1B corresponds to a migration test of smooth muscular cells from aorta. The cells are counted in 8 high power fields (hpf) and the mean and the standard deviation are indicated on the y-axis. The x-axis represents the concentration in ng/ml of the protein netrin 4 or of the mutated netrin 4 of the invention. The curve with squares corresponds to the mutated netrin 4, and the curve with diamonds corresponds to the netrin 4.

FIG. 2 corresponds to a proliferation test of HUAEC cells in order to determine the effect of supernatants of PC3 cells, said cells being transfected with the mutated netrin 4 of the invention (clones 1, and 5) or with the native netrin 4 (clones 8, 10, and 15). The y-axis represents the proliferation percentage. Column 1 is the control (DMEM alone); column 2 corresponds to non-transfected PC3 cells; column 3 corresponds to clone 1; column 4 corresponds to clone 5; column 5 corresponds to clone 8; column 6 corresponds to clone 10; column 7 corresponds to clone 15.

FIG. 3A corresponds to an analysis of the tumor progression. The x-axis corresponds to the time in days, j=0 being the day where the tumor graft is carried out. The y-axis corresponds to the tumor volumes (in mm$^3$). The curve with diamonds corresponds to the non-transfected PC3 cells; the curve with squares corresponds to PC3 cells transfected with clone 1; and the curve with triangles corresponds to PC3 ells transfected with clone 5. FIG. 3B represents the ratio of Ki67 positive cells (proliferative cells) to CD 31 positive cells (endothelial cells). The left column corresponds to the non-transfected PC3 cells; the middle column corresponds to PC3 cells transfected with clone 1; and the right column corresponds to PC3 cells transfected with clone 5. FIG. 3C corresponds to the ratio of desmin positive cells (pericytes) to CD 31 positive cells (endothelial cells). The left column corresponds to the non-transfected PC3 cells; the middle column corresponds to PC3 cells transfected with clone 1; and the right column corresponds to PC3 ells transfected with clone 5.

FIGS. 4A and 4B represent the analysis of the tumor progression of colon carcinoma LS 174 cells either untransfected (nt) (FIG. 4A) or transfected with a vector carrying the full sequence of mutated NET-4m (transfected clone FS3) (FIG. 4B) in the presence of AVASTIN®. The y-axis represents the tumor volume (in mm$^3$) and the x-axis the time (in days) after the inoculation of cancer cells xenografts. At day 12, when the average mean tumor volume reached 400 mm$^3$, Avastin was injected intraperitoneally at a dose of 50 µg/injection. The curves with squares correspond to un-treated tumor cells and the curves with diamonds correspond to AVASTIN-treated tumor cells.

FIGS. 5A, 5B, and 5C correspond to the perfusion of a fluorescent dextran to visualize choroid neo-vessels around a laser impact in grey in the centre. The rats received two or three laser impacts at D (days)=0, and then at D=7, D=10 they received a subretinal injection of the vehicle alone (PBS) (5A) or 2 µg of netrin 4 (5B) or 100 pg of mutated netrin 4 (5C). At D=14, the rats are sacrificed and perfused by the fluorescent lectine to visualize the choroid neo-vessels that can be seen on said figures in white and that surrounding a laser impact in grey.

FIG. 6 represents a migration test of smooth muscular cells from aorta with the presence of deletion mutants of the mutated netrin 4. The cells are counted in 8 hpf and the mean and the standard deviation are represented on the y-axis. The x-axis corresponds to the concentration of the conditioned medium in µg/ml. The curve with diamonds corresponds to the medium conditioned with cells transfected with a full sequence of mutated netrin 4 (NET-4m); the curve with the squares corresponds to the medium conditioned with cells transfected with NET-4m ΔEGF; and the curve with the triangles corresponds to the medium conditioned with cells transfected with NET-4m ΔCter (aa1-477).

FIG. 7 represents the results of a matrigel assay for the mutated netrin 4 (N4 m) of the invention. Netrin 4 and NET-4m inhibit VEGF and FGF-2-induced dermal angiogenesis. 300 µl matrigel pellets were mixed with 100 ng of VEGF and FGF-2 in the presence of 2 µg of netrin 4 (N4) or 1 ng of N4m or in the absence of N4 or N4m (column "C") and then injected subcutaneously into the flanks of C57/B16 mice. After 7 days, mice were killed, pellets were recovered and their hemoglobin content was measured (y-axis: hemoglobin in mg/mg Matrigel).

FIGS. 8A and 8B represent the results of the in vitro angiogenesis assays. FIGS. 8A-1, 8A-2, and 8A-3 represent the microcapillary network of HUAEC cells seeded on Matrigel: FIG. 8A-1 corresponds to the control, FIG. 8A-2 corresponds to the use of wild-type netrin 4 and FIG. 8A-3 corresponds to the use of mutated netrin 4.

FIG. 8B represents the quantification of the dose-response activity of mutated Netrin-4. The y-axis represents the branching (% of control) and the x-axis represents the concentration of mutated netrin-4 (the column C is the control).

FIG. 9C corresponds to the endocavital face of peritoneum in FS3 and LS174 injected mice.

FIG. 10 represents the analysis of the tumor progression of PC3 cells transfected or not. The y-axis represents the tumor volume (in mm$^3$) and the x axis the time (in days). The curve with diamonds corresponds to the PC3 cells; the curve with squares corresponds to the injection of pericytes to nude mice bearing a tumor derived from PC3 cells; the curve with triangles corresponds to PC3 cells transfected with mutated netrin-4, and the curve with crosses corresponds to the injection of pericytes.

Figure 11:
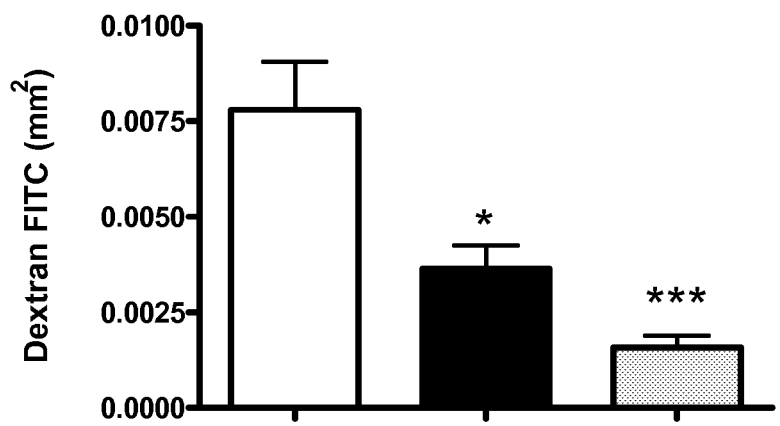

FIG. 11 corresponds to the perfusion of a fluorescent dextran to visualize choroid neo-vessels around a laser impact. The mice received two laser impacts at day D (days)=0, and then at D=7, D=10 they received a subretinal injection of the vehicle alone (PBS) or 100 pg of NET-4m Delta C or 20 pg of NET-4m. At day 14 the mice are sacrificed and perfused by the fluorescent lectin to visualize the choroid neo-vessels. The staining of fluorescent dextran was then analysed by adobe photoshop and quantified as the mean of 8-12 laser impact areas.

The white column corresponds to Buffer; the black column corresponds to DeltaC NET-4m purified from transfected CHO cells; the gray column corresponds to NET-4m purified from CHO transfected cells.

Figure 12:
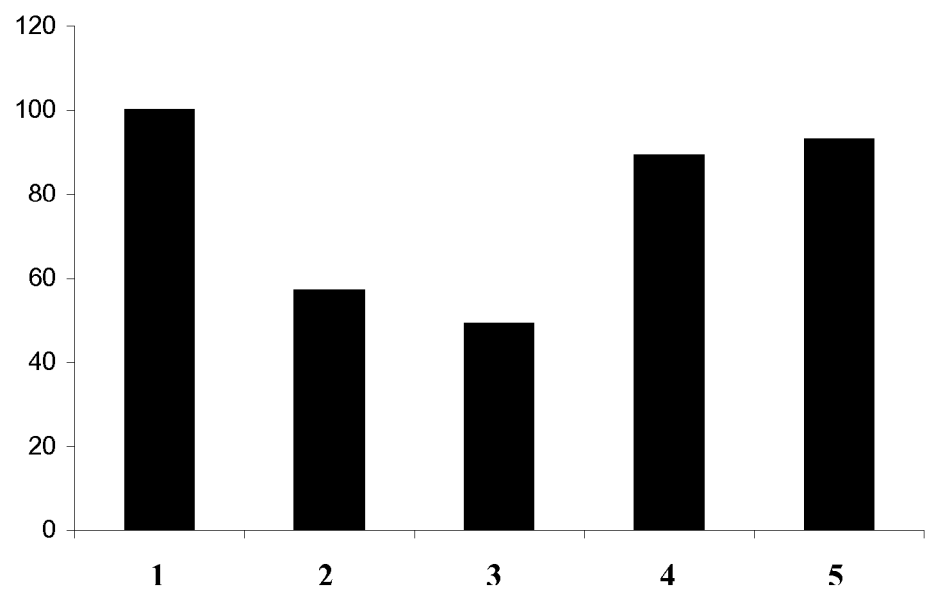

FIG. 12 corresponds to an analysis of the tumor progression. The y-axis corresponds to the tumor percentage of control. The column 1 corresponds to the non-transfected LS174 cells; the column 2 corresponds to LS174 cells transfected with clone FS2; the column 3 corresponds to LS174 cells transfected with clone FS3; the column 4 corresponds to LS174 cells transfected with clone DeltaC1; the column 5 corresponds to LS174 cells transfected with clone DeltaC2.

Figure 13:
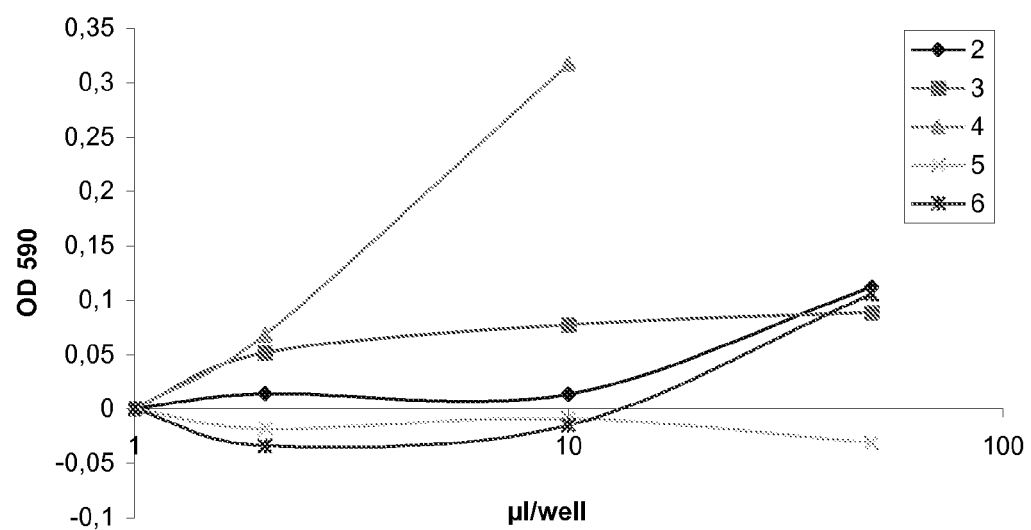

FIG. 13 corresponds to an analysis of the effect of Netrin-4 mutants on the proliferation of SMC. Pgs A-745 CHO cells were transfected with the pcDNA-3 expression vectors containing substitution netrin mutants 2 to 6 (sNET-4m). After 16 hours, the cells were washed with fresh medium and the conditioned media were collected after 48 hours. The proliferation activity on SMC was measured as previously described.

The y-axis represents the optical density (OD) at 590 nm. The x-axis represents the volume (in micro-litters; μL) of conditioned medium added by well containing pgs A-745 CHO cells.

Curve with diamond corresponds to sNET-4m no: 2, curve with square corresponds to sNET-4m no: 3, curve with triangle corresponds to sNET-4m no: 4, curve with cross corresponds to sNET-4m no: 5 and curve with star corresponds to sNET-4m no: 6.

Experimental Part

Materials

The molecules netrin 4 (SEQ ID NO: 178), and the mutated netrin 4 (SEQ ID NO: 2) are recombinant proteins. The molecule netrin 4 is available by R&D.

The isoform of 165 amino acids of VEGF is produced by the infection of insect cells SF9 by a recombinant baculovirus containing the corresponding cDNA (Plouët J, Moro F, Coldeboeuf N, Bertagnolli S, Clamens S, Bayard F (1997) Extracellular cleavage of the vascular endothelial growth factor 189 aa form by urokinae is required for its mitogenic activity. *J. Biol. Chem.*, 272, 13390-13396).

Human umbilical arterial endothelial cells (HUAEC) were isolated from umbilical arteries which were perfused with collagenase (Sigma) to digest the basal membrane. HUAEC cells were maintained in EBM medium (Clonetics), to which 15% of heat-inactivated foetal calf serum (FCS), 100 μg/ml of penicillin, and 100 μg/ml of streptomycin at 37° C. in 10% $CO_2$ were added. The stem cultures received 2 ng/ml of VEGF at each even day.

Smooth muscular cells from aorta were maintained in DMEM medium to which 15% of heat-inactivated foetal calf serum (FCS), 100 μg/ml of penicillin, and 100 μg/ml of streptomycin at 37° C. in 10% $CO_2$ were added. The stem cultures received 2 ng/ml of FGF-2 every other day.

Identification of a Mutated Netrin 4

Cloning of the Mutated Netrin 4

Total RNA of cells of the artery of human umbilical cord (HUAEC) were extracted with TriPure (Roche). Then the RNAs were transcribed by using the RT-PCR kit (AMV) of Roche according the manufacturer's indications.

Primers (5')-TT CTA GAC ATG GGG AGC TGC GCG CGG-(3') (sense) (SEQ ID NO: 210) and (5')-C ATT AAC GTC GAA CTG ACA GGT ATC-(3') (antisense) (SEQ ID NO: 211) were used for the amplification of the sequence 1-1039 of the netrin 4, while the primers (5')-AG CAC TGT GCC CCG TTA TAC AAT GA-(3') (sense) (SEQ ID NO: 212) and (5')-CGG GAT CCA CTT GCA CTC TCT TTT TAA AAT ATC C-(3') (antisense) (SEQ ID NO: 213) were used for the amplification of the sequence 914-1884 of the netrin 4.

The conditions for the amplification were: 35 cycles with denaturation at 94° C. for 1 minute; hybridization at 55° C. for 1 minute; and extension at 72° C. for 1 minute.

The products as obtained were mixed and used for a new PCR with the primers (5')-TT CTA GAC ATG GGG AGC TGC GCG CGG-(3') (sense) (SEQ ID NO: 210), and (5')-CGG GAT CCA CTT GCA CTC TCT TTT TAA AAT ATC C-(3') (antisense) (SEQ ID NO: 213) in the same conditions as described previously, with 25 cycles instead of 35. This PCT product containing the whole sequence of the netrin 4 was cloned in the intermediary vector pCR2.1 (Invitrogen). After the digestion by Xba I and Bam HI, the sequence of the netrin 4 was extracted from this vector and inserted into the pcDNA3.1 (−)/His myc C vector, said vector being digested by the same restriction enzymes. This last vector that contains the whole sequence of the mutated netrin 4 was used to transfect cells. An identical manipulation has led to the obtaining of an expression vector of the wild netrin 4 by using the sequence of the wild netrin 4.

The mutated netrin 4 was produced by the transfection of pgsA 745 CHO cells with the vector containing the sequence of the wild netrin 4 according to the protocol as described in: Plouët J, Moro F, Coldeboeuf N, Bertagnolli S, Clamens S, Bayard F (1997) Extracellular cleavage of the vascular endothelial growth factor 189-amino acid form by urokinase is required for its mitogenic activity. *J. Biol. Chem.*, 272, 13390-13396. The protein was purified by heparin-sepharose affinity chromatography and eluted with a discontinuous gradient of NaCl (0.3, 1.0, and 2.0 M NaCl). The mutated netrin 4 of the invention (NET 4m) is eluted with NaCl2M, and it has a purity degree higher than 90%.

Figure 1A:
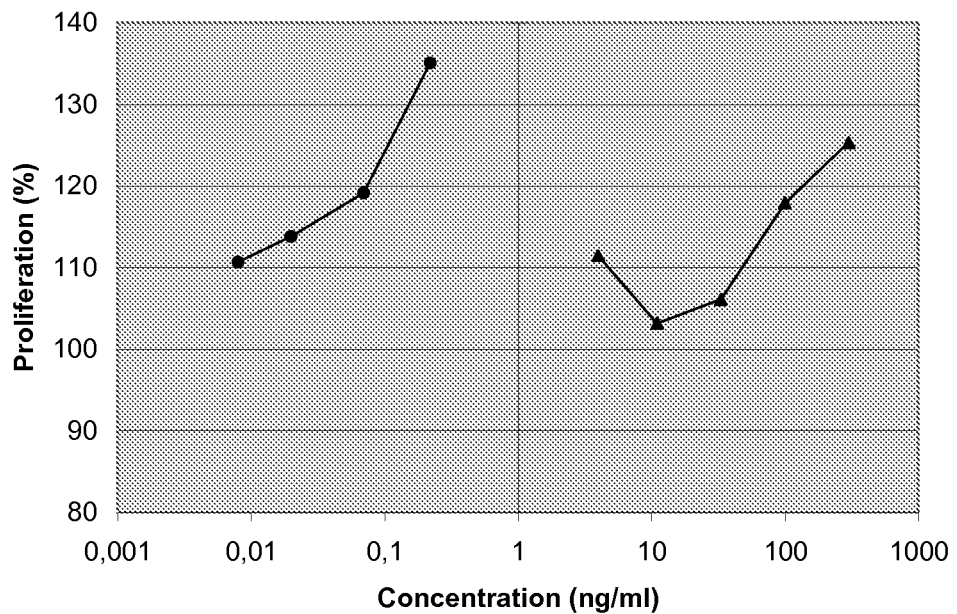

The biological activity of the mutated netrin 4 (NET 4m) was compared to the activity of the wild netrin 4 (NET 4) according to the proliferation test of the smooth muscular cells. FIG. 1A shows that NET 4m triggers a mitogenic activity at a concentration that is 1,000-fold less than the one of NET 4. Similarly, in a migration test, NET-4m is 1,000-fold more active than NET-4 (see FIG. 1B).

Construction of Deletion Mutants for the Mutated Netrin 4

The vector pcDNA3.1 (−)/His myc C containing the whole sequence of the mutated netrin 4 (628 amino acids) was digested by the restriction enzyme BamH1, treated with the fragment klenow of the polymerase 1, then digested with the restriction enzyme PshA1. The linearized fragment that corresponds to the vector pcDNA3.1 (−)/His myc C containing the sequence of the mutated netrin 4 from which the Cter domain (478-628) was deleted was then isolated after migration on agarose gel and is purified on a Qiagen column. After ligation, an expression vector pcDNA3.1 (−)/His myc C containing the sequence of the mutated netrin 4 from which the Cter domain was deleted (1-477) was obtained. The vector pcDNA3.1 (−)/His myc C containing the whole sequence of the mutated netrin 4 (628 aa) was digested by the restriction enzyme Xcm1. This enzyme that cuts the internal sequence of the netrin 4 in two sites (aa288/aa488) enables the deletion of the central domain of the protein (domain V with EGF motifs). After the purification and the ligation of the fragment, an expression vector pcDNA3.1 (−)/His myc C containing the sequence of the mutated netrin 4 from which the central domain was deleted (288/488) was obtained. However as the ligation of both sites Xcm1 leads to the onset of a stop codon (aa 313), this vector codes for a mutated netrin 4 that is truncated of 312 amino acids and that contains the sequence of the laminin domain (1-288) and a protein sequence of 24 amino acids.

Production of Anti-Idiotypic Antibodies

Firstly, a neutralizing antibody of the mutated netrin 4 of the invention or of a fragment of said mutated netrin 4 (SEQ ID NO: 2 to 72) was prepared by injecting to an animal, in particular a mouse, said mutated netrin or said fragment in admixture with Freund's complete adjuvant (1 volume for a volume of netrin or netrin fragment). A quantity of mutated netrin or netrin fragment varying from 10 to 500 μg/kg of body weight was used to immunize the animal. The same procedure was carried out after 15 and 30 days, except that the complete adjuvant was replaced by incomplete adjuvant. At day 40 the animals were bled, the serum was separated, and the immunoglobulins were purified by any usual fractionation method, in particular ammonium sulphate precipitation, protein A- or protein G-affinity chromatography. The neutralizing activity of the immunoglobulins was measured by any described test (for an example, for the mutated netrin 4 of the invention or one of its fragments: bonding of labelled netrin 4 to the extracellular domain of any one of its receptors, proliferation, migration, cell adhesion). Thus a group of immunoglobulins was considered as neutralizing when it was able to inhibit the interaction of the mutated netrin 4 either with the extracellular domain of dcc, neogenin, UNC5A, UNC5B, UNC5C or UNC5D.

Figure 7:
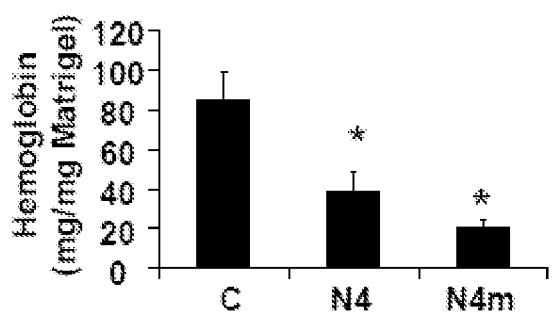

Then anti-idiotypic antibodies of the mutated netrin 4 or of one of its fragments were prepared by injecting to mice by subcutaneous route 1 to 100 μg of the preparation of the immunoglobulins that neutralize the activity of said mutated netrin or said fragment as described previously, in association with 100 μl of adjuvant, in particular of Freund's complete adjuvant (Sigma). The injection was repeated 15, 30, and 45 days later. Fifty five days after the first injection, 10 μg of the same antibody were injected to mice by intraperitoneal route. Fifty eight days after the first injection, the mice were bled and their spleens were sampled and dilacerated in ISCOVE medium in order to release the splenocytes. The splenocytes were fused with mice's myeloma cells, in particular with AG8X 63 cells (Kearney J F, Radbruch A, Liesegang B, Rajewsky K (1979) A new mouse myeloma cell line that has lost immunoglobulin expression but permits the construction of antibody-secreting hybrid cell lines. *J. Immunol.* 123, 1548-50), and were incubated at a ratio of 100,000 cells/well. The fusion was carried out by adding 20 times a volume of 50 μl of polyethylene glycol (PEG) within an interval of 30 seconds. Four ml of 37° C.-preheated ISCOVE medium were then added dropwise to the cell suspension, and then, after an incubation time of 4 minutes at 37° C., 4 ml were added. The centrifugation was centrifuged then the cell centrifugation pellet was resuspended in 100 ml of ISCOVE medium complemented with 20% of foetal calf serum and HAT 1× (50×: Hypoxanthine 5 mM, Aminopterin 20 μM and Thymidine 0.8 mM) and distributed at a volume of 100 μl per well on macrophages. After 5 days, 100 μl of HAT medium were added, and after 8 to 14 days, the conditioned medium of each hybridoma was sampled to measure by ELISA the antibodies that were directed against the antibodies used as immunogenic agents, that is to say the anti-netrin antibodies. The activity of the anti-idiotypic antibodies was then measured by an ELISA test.

The Fab fragments of the anti-mutated netrin 4, prepared by any usual technique, in particular by papain digestion, were immobilized on microtitration plates (0.1-20 μg/ml in carbonate buffer 50 mM pH 9.6). After saturation of the non-specific sites by a solution of albumin serum diluted at 5 mg/ml in the same buffer, the supernatants of hybridomas cultures were added as half-diluted in PBS buffer (phosphate buffer) containing 0.05% Tween 20. After rinses, the anti-idiotypic antibodies were revealed by the addition of an appropriate concentration of mice peroxydase-coupled anti-Fc antibodies. The amount of fixed anti-idiotypic antibodies was then measured by revelation of the peroxydase and was proportional to the intensity of the colorimetric reaction.

The hybridomas were selected according to their ability to secrete antibodies against anti-mutated netrin 4 antibodies, and these selected hybridomas were then cloned: more precisely, the cells were grown in limit dilution condition (5 cells/ml) in a volume of 0.1 ml per well. The medium was changed after 10 days. After 15 days, some of the wells contained cell groups that grew from the starting cell, and these cells thus were identical and originated from the same clone. When the surface that was covered by the cells was at least half of the total surface of the well, the medium was sampled and analysed.

A second ELISA test was then carried out: goat immunoglobulins directed against the Fc domains of the human IgG were incubated on microtitration plates (0.1-20 μg/ml in carbonate buffer 50 mM pH 9.6). After saturation of the non-specific sites by a solution of albumin serum diluted at 5 mg/ml in the same buffer, the proteins containing the extracellular domains of the netrins receptors fused to a Fc sequence of human IgG were immobilized on the microtitration plates (incubation at a concentration of 1 to 100 μg/ml). The supernatants of the hybridomas cultures were added as half-diluted in PBS buffer containing 0.05% Tween 20. After rinses, the anti-idiotypic antibodies were revealed by the addition of an appropriate concentration of mice peroxydase-coupled anti-Fc antibodies. The amount of fixed anti-idiotypic antibodies was then measured by revelation of the peroxydase and was proportional to the intensity of the colorimetric reaction.

As soon as the clones were identified, their monoclonal state was confirmed by the usual procedure that consisted in seeding a 96 wells-plate with cells originating from the same clone and diluted in limit conditions as described previously. The secreting clones should thus secrete an antibody with the same specificity in order to be considered as monoclonal. A third cloning was then carried out exactly in the same conditions to ensure that the clones were monoclonal.

The monoclonal anti-idiotypic antibodies were screened by a series of tests, in particular by an ELISA test on extracellular domains of the known netrins receptors (dcc, neogenin, UNC5-A, UNC5-B, UNC5-C, UNC5-D), or measurement of the inhibition of the proliferation or migration of HUAEC cells or in vivo measurement tests of an anti-angiogenic activity.

Thus the anti-idiotypic antibodies were mimes of the netrins domains. The aim was to design an "internal image" of a netrin domain and to obtain an antibody that binds to a netrin receptor but that does not bind to all the receptors. As soon as the specificity was confirmed, the agonist function of this antibody was ascertained by measuring its activity on cells, that is to say by inhibiting the HUAEC functions without inhibiting or stimulating the netrins functions on SMC and/or by stimulating SMC without affecting HUAEC.

The interest of these antibodies was to be able to mimic a function of the netrins on a cell target without affecting other targets. Thus it would be interesting to stimulate the pericytes functions without inducing the apoptosis of the endothelial cells or to inhibit their migration, their proliferation, their differentiation in some pathologies:

- age-related macular degeneration,
- diabetic retinopathy, at a premature state where the pericytes rarefaction precedes neovascularisation,
- neovascular glaucoma (of the cornea, of the retina . . . ),
- rheumatoid arthritis,
- psoriasis, in particular psoriasis arthritis,
- angioma,
- atherosclerosis,
- obesity,
- cancers.

Inversely it would be interesting to inhibit the proliferation of endothelial cells without affecting the pericytes for the above-mentioned pathologies.

Angiogenenesis' s Inhibition

In order to increase the specific activity of netrin-4 point mutations were inserted in its sequence and produced various mutants in CHO cells. One of them referred as NET-4m (mutated netrin-4 of the invention) exhibited a 2000-fold gain of function in the matrigel assay (FIG. 7). Neither netrin-4 (NET-4) nor NET-4m had any pro-angiogenic effect in the absence of VEGF and FGF-2. These results disagree with the report by Park (K. W. Park et al., *Proc. Natl. Acad. Sci. U.S.A* 101, 16210-16215 (2004)) which describes netrin-1 as pro-angiogenic in the corneal angiogenesis assay. This discrepancy might be explained by the fact that netrins have a strong affinity for heparansulfates and thus may displace endogenous FGF-2 from its storage sites in the corneal stroma; a similar phenomenon for VEGF 189 was previously noticed (F. Jonca, N. Ortega, P. E. Gleizes, N. Bertrand, J. Plouet, *J. Biol. Chem.* 272, 24203-24209 (1997)). Recent evidences demonstrate that corneal vascularization depends of soluble VEGFR-1 expression (B. K. Ambati et al., *Nature* 443, 993-997 (2006)) which might be by netrins. Although neogenin or Unc5B could not be detected in adult retinas, an increase of their expression was noticed after laser-induced injury (data not shown). Indeed subretinal injections of NET-4m (1 ng), after the onset of angiogenesis, reduced choroid neovascularization, as visualized by dextran perfusion, by more than 70% (FIG. 5C). The PC3 prostatic cancer-derived cell line was used to decipher the potential effect of netrin-4 in tumor angiogenesis. PC3 prostate cancer cell proliferation was not affected by addition of exogenous netrin-4. These cells were then transfected with expression vectors encoding NET-4m and screened the ability of their conditioned medium to inhibit HUAEC proliferation. The proliferation (FIG. 7) and secretion of VEGF ($4.5 \pm 0.2$ ng/$10^6$ cells/48 h) by these cells were similar to those of parental cells, so analyzing tumor growth was informative. Two clones and parental cells transfected with the empty vector were grafted into nude mice, and tumor volume recorded. Both the tumor take and the growth curve slope were reduced by netrin-4 constitutive expression Immunohistochemistry analysis showed two major features. First, the overall proliferation index was reduced by 50% in tumors derived from clone 1 and 70% in those from clone 5 with respect to empty vector-transfected cells. Secondly, the number of CD 31-positive cells appeared significantly reduced by netrin-4 overexpression. In addition the number of Desmin-positive cells increased in a parallel fashion tumors, therefore decreasing the ratio CD31/Desmin to 2 and 3-fold respectively. Unlike α smooth muscle actin or NG2, Desmin is a marker of mature pericytes (S. Song, A. J. Ewald, W. Stallcup, Z. Werb, G. Bergers, *Nat. Cell Biol.* 7, 870-879 (2005)). Therefore netrin-4 may inhibit tumor progression by a dual mechanism involving eradication of angiogenic EC (endothelial cells) and stimulation of mature pericytes to cover EC, contributing to control EC proliferation through activation of latent TGF (A. Antonella-Orlidge, K. B. Saunders, S. R. Smith, P. d'Amore *Proc Natl Acad Sci USA.* 86, 4544-4588 (1989)). Both activities should induce neovessel stabilization. Indeed, this attractive hypothesis (R. K. Jain, *Nat. Med.* 9, 685-693 (2003)) has only been documented by pro-angiogenic withdrawal. These results demonstrate for the first time that altering the balance between pro-angiogenic and anti-angiogenic modulators by increasing the level of endogenous anti-angiogenic factor is a plausible approach to fight tumor angiogenesis.

In Vitro Angiogenenesis

In vitro angiogenesis assays were performed using HUAEC ($10^5$ cells/cm$^2$) seeded on growth factor-reduced Matrigel (BD Biosciences) and incubated at 37° C. for 1 hour. Then 50 ng/ml of VEGF was added, the samples incubated for 2 hours and 400 ng/ml of netrin-1 or netrin-4 was added and incubation continued for 5 more hours. The plates were then rinsed with PBS and fixed at room temperature with 1% glutaraldehyde. The mean microcapillary network was measured using an automated computer-assisted image analysis system, and the total length of the capillaries in each well was determined (μm) for each experimental condition. Experiments were performed in triplicate and repeated at least three times.

As shown in the FIG. 8A, HUAEC cells seeded on Matrigel form tubule-like structures, whereas the addition of either 400 ng/ml of wild-type Netrin-4 (NET-4) or 400 pg/ml of mutated Netrin-4 (NET-4m) totally abolished this sprouting. Dose response activity of mutated Netrin-4 was quantified in the lower panel (FIG. 8B) and it appears that half-maximal inhibition was obtained with a concentration of about 500 pg/ml.

Comparison of the Activity of NET-4 and NET-4m on Proliferation (FIG. 1A) and Migration (FIG. 1B) of the SMC Plates with 96 wells were seeded with 2,000 SMC (smooth muscular cells) per well in DMEM medium complemented with 10% FCS. After 6 hours the cells were transferred in DMEM medium containing 2% FCS and were then stimulated (or not) with various concentrations of netrin 4 (NET-4) or of mutated netrin 4 (NET-4m). After 5 days, the wells were rinsed with DMEM and the cells were fixed with 1% glutaldehyde, coloured with violet crystal and solubilized with acetic acid. The optical density was measured at 595 nm. Similar results were obtained in three independent experiments. The indicated values are mean optical densities of 6 wells±standard deviation (SD).

Proliferation Test of SMC (FIG. 1A)

The mutated netrin 4 was produced by transfecting pgsA 745 CHO cells with the vector containing the sequence of the wild netrin 4 according to a known procedure (Plouët J, Moro F, Coldeboeuf N, Bertagnolli S, Clamens S, Bayard F (1997) Extracellular cleavage of the vascular endothelial growth factor 189 aa form by urokinae is required for its mitogenic activity. *J. Biol. Chem.*, 272, 13390-13396). The protein was purified by heparin-sepharose affinity chromatography and eluted with a discontinuous gradient of NaCl (0.3, 1.0 and 2.0 M NaCl). NET-4m was eluted with NaCl2M and has a purity degree greater than 90%.

The biological activity of NET-4m was compared with the activity of wild NET 4 according to the smooth muscular cells proliferation test. FIG. 1A shows that half of the maximal stimulation was obtained with a concentration of 120 ng/ml of non-mutated netrin 4 (NET-4) and 0.1 ng/ml of mutated netrin 4 (NET-4m). This means that the mitogenic activity of the mutated netrin 4 is thousand times as active as the non-mutated netrin 4.

Figure 1B:
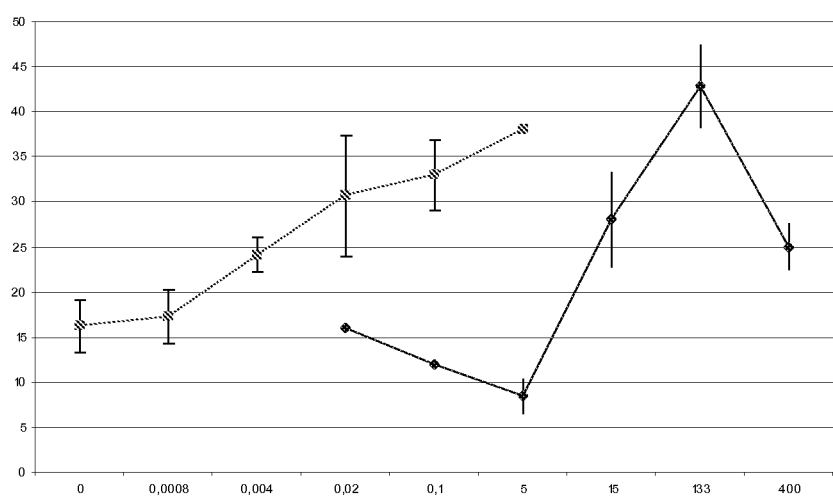

Migration Test of the SMC (FIG. 1B)

The confluent monolayer of SMC is incubated during one night in the presence of DMEM. A wound is made in the monolayer with a rubber policeman and the wells were washed three times with DMEM and then incubated in the presence of varying concentrations of netrin 4 (NET-4) or mutated netrin 4 (NET-4m). After 24 hours, the wells were washed three times and coloured with May-Grunwald-Giemsa and photographed and the cells are counted in 8 hpf per condition. The results are given in number of cells per hpf.

It appears that half of the maximal stimulation is obtained with a concentration of 12 ng/ml of non-mutated netrin 4 (NET-4) and 0.004 ng/ml of mutated netrin 4 (NET-4m). This means that the chimiotactic activity of the mutated netrin 4 is 3,000 times as active as the non mutated netrin 4.

Transfection of PC3 Cancer Cells

Prostate cancer cells (PC3) and Colon carcinoma are grown in DMEM medium complemented with antibiotics and foetal calf serum 10%. The transfection protocol was established as follows:

D1: inoculation of low density cells (10,000 cells/cm$^2$) in a 10 cm diameter box D2: transfection with pcDNA3-NET4 or pcDNA-3-NET-4m 5 µg of plasmid were mixed with 5 µl of lipofectine and 100 µl of DMEM (without antibiotics) for half-an-hour at ambient temperature and softly mixed. The mixture is then diluted at 5 ml in DMEM and deposited dropwise in the box containing the PC3 cells. After an incubation of 6 hours in an incubator at 37° C., the medium is pumped out and replaced with 10 ml of fresh medium, D3: rinsing of the box and incubation for 24 hours with DMEM medium containing 10% foetal calf serum and antibiotics, D4: trypsinisation of the cells, incubation in four 10 cm diameter boxes in complete DMEM medium complemented with 500 µg/ml of geneticine (Sigma)

D17: sampling of cells clones (100-400 cells/clone) with a micropipette and transfer into wells of 2 cm$^2$ D24: trypsinisation and incubation of cells clones in boxes with 12 wells (120,000 cells/well)

D27: rinsing of the wells and inoculation in DMEM medium without serum

D30: collecting of the conditioned media and analysis of the quantification of netrin 4 in each medium.

After the checking that the clones transfected with netrin 4 (NET-4) or mutated netrin 4 (NET-4m) have an equivalent duplication time (26-30 hours), the content of netrin 4 of each medium was measured as described previously in the paragraph relating to the proliferation test. 4 µl of conditioned medium were added to 100 µl of culture medium. The results are given in proliferation percentage in comparison with the control (well containing 4 µl of DMEM medium).

According to the FIG. 2, the medium of non-transfected cells as well as the clones 10 and 15 of NET 4 induce an equivalent proliferation of HUAEC cells of about 300% in comparison with the control.

On the other hand, the conditioned medium of the clones 1 and 5 of NET-4m as well as the clone 8 of NET-4 stimulate the proliferation of HUAEC cells of only 200%, which corresponds to about 50% of the proliferation as induced by the conditioned medium of PC3 cells.

Thus netrin 4 (NET-4) or mutated netrin 4 (NET-4m) induces the proliferation of HUAEC without modifying the proliferation of PC3 cancer cells.

Transfection of LS174.

Colon carcinoma LS 174 cells are grown in DMEM medium complemented with antibiotics and foetal calf serum 10%.

The transfection protocol was established as follows:

D1: inoculation of low density cells (10,000 cells/cm$^2$) in a 10 cm diameter box D2: transfection with pcDNA3-DeltaC NET-4m or pcDNA-3-NET-4m 5 µg of plasmid were mixed with 5 µl of lipofectine and 100 µl of DMEM (without antibiotics) for half-an-hour at ambient temperature and softly mixed. The mixture is then diluted at 5 ml in DMEM and deposited dropwise in the box containing the LS 174 cells. After an incubation of 6 hours in an incubator at 37° C., the medium is pumped out and replaced with 10 ml of fresh medium, D3: rinsing of the box and incubation for 24 hours with DMEM medium containing 10% foetal calf serum and antibiotics, D4: trypsinisation of the cells, incubation in four 10 cm diameter boxes in complete DMEM medium complemented with 500 µg/ml of geneticine (Sigma)

D17: sampling of cells clones (100-400 cells/clone) with a micropipette and transfer into wells of 2 cm$^2$ D24: trypsinisation and incubation of cells clones in boxes with 12 wells (120,000 cells/well)

D27: rinsing of the wells and inoculation in DMEM medium without serum

D30: collecting of the conditioned media and analysis of the quantification of netrin 4 in each medium.

After the checking that the clones transfected with netrin 4 (NET-4) or mutated netrin 4 (NET-4m) have an equivalent duplication time (26-30 hours), the content of netrin 4 of each medium was measured as described previously in the paragraph relating to the proliferation test. 4 µl of conditioned medium were added to 100 µl of culture medium. The results are given in proliferation percentage in comparison with the control (well containing 4 µl of DMEM medium).

Several clones were selected for each transfection. FS2 and FS3 are two representative clones of LS174 cells transfected with NET-4m. DeltaC1 and DeltaC2 are two representative clones of LS174 cells transfected with NET-4m DeltaC.

Analysis of the Tumorigenicity of the Clones of Transfected PC3 Cells

Non-transfected PC3 cells and PC3 cells transfected with NET4m (clones 1 and 5) were injected to nude mice's flank (1 million of cells pro injection). The length (L) and width (1) of each tumor were measured with a caliper and the volume is expressed by the formula $0.52 \times L \times l^2$. According to FIG. 3, it appears that the clones 1 and 5 give tumors much smaller than the tumors as obtained with PC3 cells. The reduction is greater than 80%.

Thus the mutated netrin 4 of the invention (NET-4m) exerts an anti-tumoral activity through its anti-angiogenic activity. It appears that mutated netrin 4 decreases the ratio of proliferating cells by 30% (clone 1) and 60% (clone 5), respectively. It also appears that mutated netrin-4 expression in PC3 cells increases the pericyte coverage of endothelial cells by 1.3 (clone 1) and 2-fold (clone 5), respectively. In fact the decrease of the ratio CD31/desmin (FIG. 3C) indicates that there are less endothelial cells which are not covered by pericytes in tumors obtained from PC3 cells transfected with mutated netrin-4.

Analysis of the Tumorigenicity of the Clones of Transfected LS 174 Cells

Non-transfected LS 174 cells, LS 174 cells transfected with NET-4m (FS3 and FS4) and LS 174 cells transfected with DeltaC NET-4m (DeltaC1 and DeltaC2) were injected to nude mice's flank (1 million of cells pro injection). The length (L) and width (1) of each tumor were measured with a caliper and the volume is expressed by the formula $0.52 \times L \times l^2$. Tumor volumes were recorded at J 25 and expressed as percentage of the volume of non transfected LS174 tumors.

According to FIG. 12, it appears that the clones FS2 and FS3 give tumors much smaller than the tumors as obtained with LS 174 cells, or LS 174 cells transfected with DeltaC NET4m.

Thus the mutated netrin 4 of the invention (FS2 and FS3) exerts an antitumoral activity through its anti-angiogenic activity. It appears that DeltaC deleted netrin4 tumors behave as the parental cells thus demonstrating that the C-terminus sequence of netrin4 is required for its anti tumor angiogenesis activity whereas it is not for its activity to inhibit choroidal angiogenesis.

Synergic Effect of NET-4m on the Inhibition of VEGF

It is now well known that VEGF is a major actor of the pathologic angiogenesis and that its inhibition is a major therapeutic pathway. An anti-VEGF antibody is commercialized under the name AVASTIN®. Knowing that the netrin 4 (NET-4) acts through a mechanism of action differing from the one of the VEGF, the synergic effect of the netrin 4

(NET-4) with an anti-VEGF antibody commercialized under the name of AVASTIN® was measured.

Mice received a graft of non-transfected colon carcinoma LS 174 cells or of LS 174 cells transfected with NET-4 (clones FS3 8, 10 or 15). As soon as the tumors had a volume greater than 400 mm$^3$, the mice received a peritoneal injection of AVASTIN® (50 µg every 3 days), said dose corresponding to the therapeutic recommendations in human pathology (10 mg/kg/every other week) and the tumor volume was measured as described previously.

It appears on FIG. 4A that AVASTIN® has no effect on non-transfected LS 174 and that the doubling time of the tumors treated or not was 3 to 4 days. On the contrary the volume doubling time of the transfected clone FS3 was of 5 days in untreated mice and 9 days in treated mice (FIG. 4B): thus the netrin 4 allowed the restoration of the sensitivity to anti-VEGF treatments in great tumors.

Figure 6:
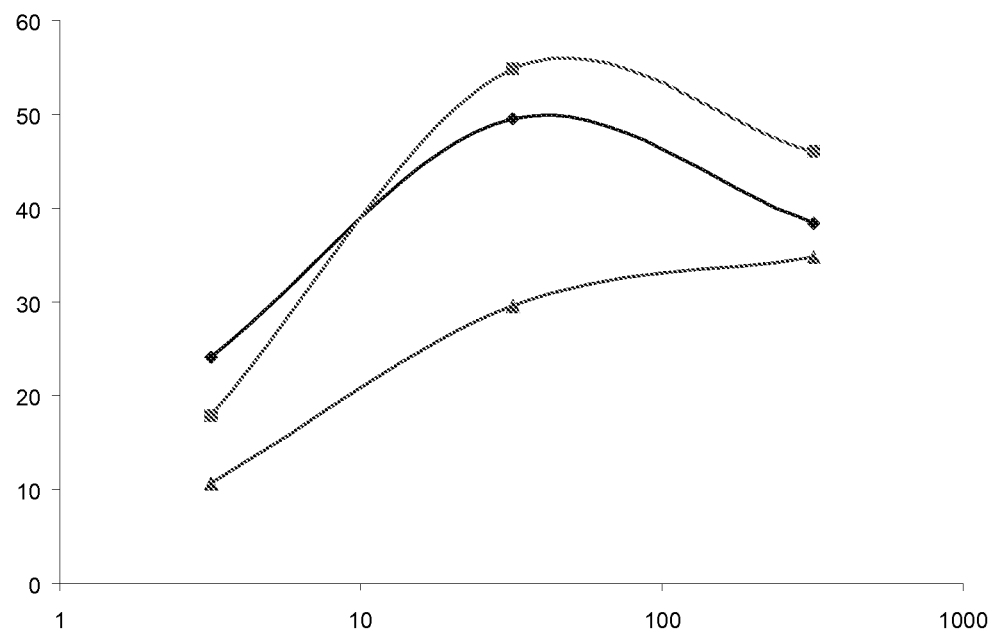

Effect of NET-4m (MC4) on the Migration of SMC pgsA-745 CHO cells were transfected with the PCDNA-3 expression vectors containing the whole sequence of mutated netrin 4 (MC4). After 16 hours, the cells were incubated with DMEM medium and the conditioned media were collected after 48 hours. The migration activity on SMC cells was measured as described previously (see FIG. 6).

Choroid Neovascularization (FIGS. 5A, 5B, 5C and 11)

Eight-week old Brown Norway rats (Janvier, Le Genest-St Isle, France) were anesthetized by intraperitoneal injection of 0.14 ml sodium pentobarbital (Sanofi Santé Animale). The pupils were dilated with 1% tropicamide (Théa, Clermont-Ferrand, France). Photocoagulation lesions were created around the optic nerve 1 to 2 disc diameters away from the papillae with an argon laser photocoagulator (Quantel Medical Clermont-Ferrand, France) set at 532 nm, mounted on a slit lamp and with a cover glass fulfilling the role of contact lens (parameters fixed to 150 mW, 100 ms and 100 µm). In all treated eyes included in the study, a reactive bubble at the retinal surface was observed after laser delivery as evidence for appropriate focusing and an indication of the rupture of Bruch's membrane. Rats were injected with netrin4 (1 ng of NET-4m) in a volume of 5 µl under the subretinal space on days 7 and day 10 after laser photocoagulation. 14 days after laser treatment, all animals were perfused with 1 ml of PBS containing 50 mg/ml fluorescein-labelled dextran (FITC-dextran; average molecular mass, 2×10$^6$; Sigma-Aldrich) and sacrificed. The eyes were harvested and fixed in PBS 4% paraformaldehyde (PAF) solution (LADD, Inland Europe, Conflans-sur-Lanterne, France). Retinas and choroids were dissected, and fixed for an additional 15 minutes at room temperature in methanol. The enucleated eyes were sectioned at the equator and the anterior half, including the lens and vitreous, was discarded. The retinas were carefully peeled from the eyecup and optic nerve by using specialized scissors and forceps under a biomicroscope (Wild M3Z, Heerbrugg). The posterior eye segment containing the complex sclera-choroid and the retina was dissected into quarters by four radial cuts. After washing in PBS, the flat mounts were mounted with Gelmount® (Biomeda, Foster City, Calif., USA), air-dried and examined under a fluorescence microscope (BX51; Olympus, Melville, N.Y.) at 488 nm or 594 nm excitation wavelength as appropriate. The incidence and size of the CNV complex were scored by morphometric analysis of the images with Image J Software (v1.36, NIH, USA). Subretinal injections of NET-4m (1 ng), after the onset of angiogenesis, reduced choroid neovascularization, as visualized by dextran perfusion, by more than 70%.

C57BL/6 mice (Janvier, Le Genest-St Isle, France) were anesthetized by intraperitoneal injection of 0.14 ml sodium pentobarbital (Sanofi Santé Animale). The pupils were dilated with 1% tropicamide (Théa, Clermont-Ferrand, France). Photocoagulation lesions were created around the optic nerve 1 to 2 disc diameters away from the papillae with an argon laser photocoagulator (Quantel Medical Clermont-Ferrand, France) set at 532 nm, mounted on a slit lamp and with a cover glass fulfilling the role of contact lens (parameters fixed to 150 mW, 100 ms and 100 µm). In all treated eyes included in the study, a reactive bubble at the retinal surface was observed after laser delivery as evidence for appropriate focusing and an indication of the rupture of Bruch's membrane. Mice were injected with netrin4 20 pg of NET-4m) in a volume of 1 µl under the intravitreal space on days 7 and day 10 after laser photocoagulation. 14 days after laser treatment, all animals were perfused with 1 ml of PBS containing 50 mg/ml fluorescein-labelled dextran (FITC-dextran; average molecular mass, 2×10$^6$; Sigma-Aldrich) and sacrificed. The eyes were harvested and fixed in PBS 4% paraformaldehyde (PAF) solution (LADD, Inland Europe, Conflans-sur-Lanterne, France). Retinas and choroids were dissected, and fixed for an additional 15 minutes at room temperature in methanol. The enucleated eyes were sectioned at the equator and the anterior half, including the lens and vitreous, was discarded. The retinas were carefully peeled from the eyecup and optic nerve by using specialized scissors and forceps under a biomicroscope (Wild M3Z, Heerbrugg). The posterior eye segment containing the complex sclera-choroid and the retina was dissected into quarters by four radial cuts. After washing in PBS, the flat mounts were mounted with Gelmount® (Biomeda, Foster City, Calif., USA), air-dried and examined under a fluorescence microscope (BX51; Olympus, Melville, N.Y.) at 488 nm or 594 nm excitation wavelength as appropriate. The incidence and size of the CNV complex were scored by morphometric analysis of the images with Image J Software (v1.36, NIH, USA). Intravitreal injection of NET-4m or DeltaC NET-4m, after the onset of angiogenesis, reduced choroidal neovascularization, as visualized by dextran perfusion, by 74% and 62% respectively.

Data of FIG. 5 A, B, C and FIG. 11 demonstrate that NET-4m inhibit choroidal neoivascularization in mice and rats and that NET-4m can be supplied either by subretinal or intravitral route.

Peritoneous Carcimomatosis

10$^6$ LS 174 or mutated transfected LS 174 (FS3 as described above) were injected in the peritoneal cavity of Nod-Scid mice. After 21 days the carcinomatosis was recorded by the Sugerbaker's score (Observations concerning cancer spread within the peritoneal cavity and concepts supporting an ordered pathophysiology. *Cancer Treat Res.* 1996; 82:79-100). The ascite was collected and its volume was measured and photomicrographs of the peritoneal cavity were taken.

Figure 9A:
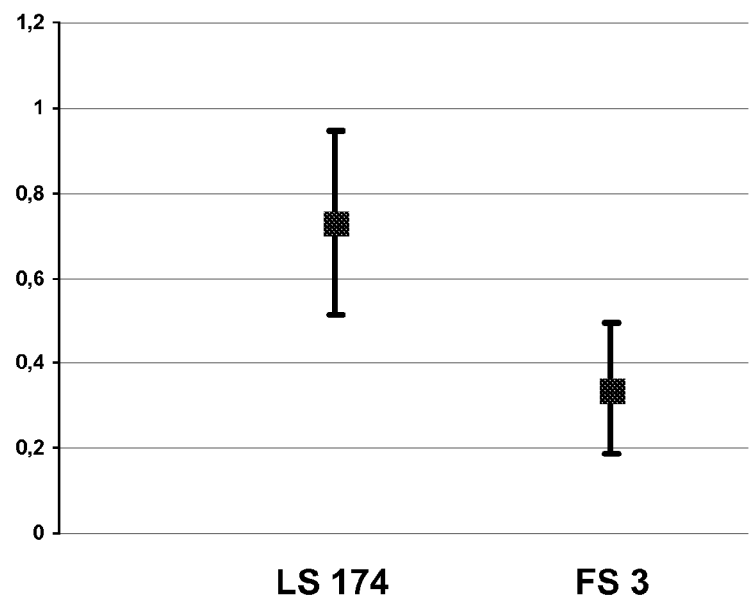
FIG. 9A represents the mean daily increase of carcinomatosis score. The y-axis is the daily score of Sugerbaker for LS 174 and FS 3 tumors.
Figure 9B:
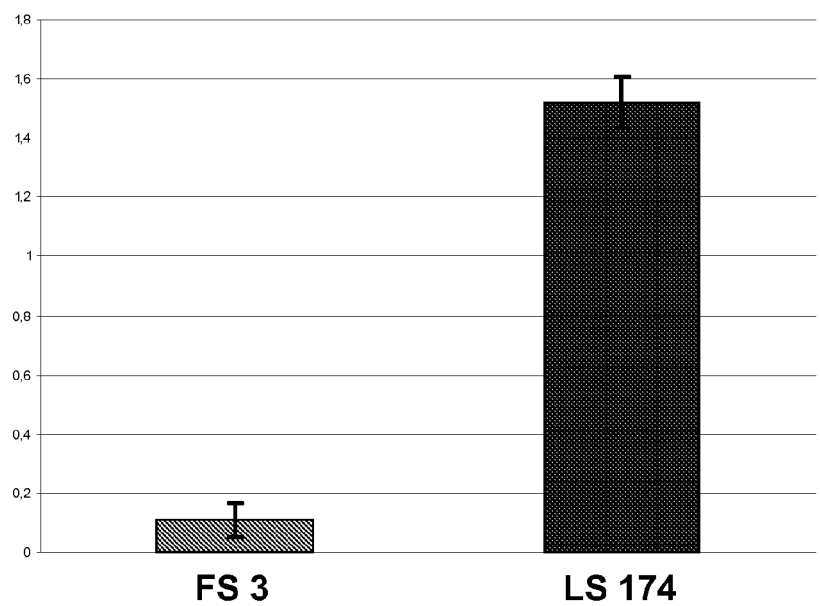
FIG. 9B represents the ascites volume in ml for F δ 3 and LS174 tumors.

As shown on FIG. 9A, the daily score of Sugerbaker was 0.78 in LS 174 tumors was 0.75±0.2 and reduced to 0.35±0.12 in FS3 tumors (p<0.05). The ascites volume (FIG. 9B) was reduced from 1.5±0.9 ml to 0.1±0.1 ml in FS3 tumors. In FIG. 9C, it appears that the endovavital face of peritoneoum contained numerous tumors aligned along new vessels in LS 174 tumors whereas the vessels were thin in FS3 injected mice and free of tumors.

Combination of Pericytes and Mutated Netrin-4 as an Anti-Cancer Agent

As shown in FIG. 10 the injection of pericytes to nude mice bearing a tumor derived from PC3 cells have no antitumoral activity. When PC3 cells are transfected with mutated netrin-4, the tumor volume is lower and is almost totally abolished by the injection of pericytes.

Production of NET-4m Proteins pgsA-745 CHO cells are grown in DMEM medium complemented with antibiotics and foetal calf serum 10%. The transfection protocol was established as follows:

D1: inoculation of low density cells (10,000 cells/cm$^2$) in a 10 cm diameter box D2: transfection with pcDNA3-NET4 or pcDNA-3-NET-4m, or other sequences as above mentioned 5 μg of plasmid were mixed with 5 μl of lipofectine and 100 μl of DMEM (without antibiotics) for half-an-hour at ambient temperature and softly mixed. The mixture is then diluted at 5 ml in DMEM and deposited dropwise in the plate containing the CHO cells. After an incubation of 16 hours in an incubator at 37° C., the medium is pumped out and replaced with 10 ml of fresh DMEM, D5: collection of the conditioned medium.

Purification of NET-4m Proteins.

Conditioned media were adjusted to pH 7.4 with 10 mM Hepes buffer and the 10 ml mixture were mixed with 200 μl of cation exchange matrix (Sp sepharose, Pharmacia) for 4 hours at 4° C. Then the mixture was centrifugated at 800 g for 5 minutes. The pellet was washed with 10 mM Hepes buffer containing 0.1 M NaCl. Then the NET-4m proteins were eluted from Sp Sepharose by stepwise NaCl gradient (0.2 M, 0.4 M, 0.8 M NaCl) under a final volume of 0.5 ml per fraction. The active NET-4m was eluted between 0.4 and 0.8 M NaCl. The active material (determined by an ELISA assay as aboved described) were diluted with 2 volumes of distilled H2O containing 10 mM Hepes and applied to an Heparin sepharose (Pharmacia) column chromatography (200 μl). The column was then washed with 1 ml of 10 mM Hepes containing 0.3 M NaCl. The NET-4m proteins were then eluted by 0.5 ml og 10 mM Hepes containing 1.2 M NaCl and assayed for their mitogenic activity on SMC cells.

FIG. 13 shows that substitution mutants (sNET-4m) 2, 5 and 6 are slightly active whereas mutant 3 and 4 retained the full mitogenic activity of NET-4m. Therefore one can assume that the mutations in the 1-332 sequence are not critical for the gain of function. Since the replacement of Tyr 472 by Cys (mutant 5) in the NET-4m sequence decreases the mitogenic activity of NET-4m to that of wild type NET-4. Therefore one can assume that the Cys 472 replacement by Tyr is responsible of the gain of function of NET-4m.

SEQUENCE LISTING (213 sequences)

SEQ ID NO: 1 - DNA, 1884 bp, Homo sapiens
  CDS (1)..(1884)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 2 - protein, 628 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 3 - DNA, 1827 bp, Homo sapiens
  CDS (1)..(1827)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 4 - protein, 609 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 5 - DNA, 765 bp, Homo sapiens
  CDS (1)..(765)
agctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 6 - protein, 255 aa, Homo sapiens
SCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 7 - DNA, 1545 bp, Homo sapiens
  CDS (1)..(1545)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 8 - protein, 515 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 9 - DNA, 1452 bp, Homo sapiens
  CDS (1)..(1452)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 10 - protein, 484 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 11 - DNA, 1791 bp, Homo sapiens
  CDS (1)..(1791)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 12 - protein, 597 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 13 - DNA, 1119 bp, Homo sapiens
  CDS (1)..(1119)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 14 - protein, 373 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 15 - DNA, 1104 bp, Homo sapiens
  CDS (1)..(1104)
agctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 16 - protein, 368 aa, Homo sapiens
SCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 17 - DNA, 507 bp, Homo sapiens
  CDS (1)..(507)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 18 - protein, 169 aa, Homo sapiens
RKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 19 - DNA, 1026 bp, Homo sapiens
  CDS (1)..(1026)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 20 - protein, 342 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 21 - DNA, 1206 bp, Homo sapiens
  CDS (1)..(1206)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 22 - protein, 402 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 23 - DNA, 1194 bp, Homo sapiens
  CDS (1)..(1194)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 24 - protein, 398 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 25 - DNA, 1182 bp, Homo sapiens
  CDS (1)..(1182)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 26 - protein, 394 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 27 - DNA, 1299 bp, Homo sapiens
  CDS (1)..(1299)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 28 - protein, 433 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 29 - DNA, 1287 bp, Homo sapiens
  CDS (1)..(1287)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 30 - protein, 429 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 31 - DNA, 1275 bp, Homo sapiens
  CDS (1)..(1275)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 32 - protein, 425 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 33 - DNA, 687 bp, Homo sapiens
  CDS (1)..(687)
agctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 34 - protein, 229 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 35 - DNA, 663 bp, Homo sapiens
  CDS (1)..(663)
cgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 36 - protein, 221 aa, Homo sapiens
RKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 37 - DNA, 843 bp, Homo sapiens
  CDS (1)..(843)
agctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 38 - protein, 281 aa, Homo sapiens
SCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 39 - DNA, 1467 bp, Homo sapiens
  CDS (1)..(1467)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 40 - protein, 489 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 41 - DNA, 1443 bp, Homo sapiens
  CDS (1)..(1443)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 42 - protein, 481 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 43 - DNA, 1455 bp, Homo sapiens
  CDS (1)..(1455)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 44 - protein, 485 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 45 - DNA, 1374 bp, Homo sapiens
  CDS (1)..(1374)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 46 - protein, 458 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 47 - DNA, 1350 bp, Homo sapiens
  CDS (1)..(1350)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 48 - protein, 450 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 49 - DNA, 1362 bp, Homo sapiens
  CDS (1)..(1362)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 50 - protein, 454 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 51 - DNA, 1623 bp, Homo sapiens
  CDS (1)..(1623)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 52 - protein, 541 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 53 - DNA, 1530 bp, Homo sapiens
  CDS (1)..(1530)
aaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 54 - protein, 510 aa, Homo sapiens
KACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 55 - DNA, 1488 bp, Homo sapiens
  CDS (1)..(1488)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 56 - protein, 496 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 57 - DNA, 1062 bp, Homo sapiens
  CDS (1)..(1062)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 58 - protein, 354 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 59 - DNA, 1242 bp, Homo sapiens
  CDS (1)..(1242)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 60 - protein, 414 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 61 - DNA, 1230 bp, Homo sapiens
  CDS (1)..(1230)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 62 - protein, 410 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 63 - DNA, 1218 bp, Homo sapiens
  CDS (1)..(1218)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 64 - protein, 406 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 65 - DNA, 1410 bp, Homo sapiens
  CDS (1)..(1410)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 66 - protein, 470 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 67 - DNA, 1386 bp, Homo sapiens
  CDS (1)..(1386)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 68 - protein, 462 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 69 - DNA, 1398 bp, Homo sapiens
  CDS (1)..(1398)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 70 - protein, 466 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 71 - DNA, 1566 bp, Homo sapiens
  CDS (1)..(1566)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 72 - protein, 522 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 73 - DNA, 1545 bp, Homo sapiens
  CDS (1)..(1545)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 74 - protein, 515 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 75 - DNA, 1119 bp, Homo sapiens
  CDS (1)..(1119)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 76 - protein, 373 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 77 - DNA, 1299 bp, Homo sapiens
  CDS (1)..(1299)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 78 - protein, 433 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 79 - DNA, 1287 bp, Homo sapiens
  CDS (1)..(1287)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 80 - protein, 429 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 81 - DNA, 1275 bp, Homo sapiens
  CDS (1)..(1275)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 82 - protein, 425 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 83 - DNA, 1467 bp, Homo sapiens
  CDS (1)..(1467)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 84 - protein, 489 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 85 - DNA, 1443 bp, Homo sapiens
  CDS (1)..(1443)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 86 - protein, 481 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 87 - DNA, 1455 bp, Homo sapiens
  CDS (1)..(1455)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 88 - protein, 485 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 89 - DNA, 1623 bp, Homo sapiens
  CDS (1)..(1623)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 90 - protein, 541 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 91 - DNA, 1545 bp, Homo sapiens
  CDS (1)..(1545)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 92 - protein, 515 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 93 - DNA, 1119 bp, Homo sapiens
  CDS (1)..(1119)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 94 - protein, 373 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 95 - DNA, 1299 bp, Homo sapiens
  CDS (1)..(1299)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 96 - protein, 433 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 97 - DNA, 1287 bp, Homo sapiens
  CDS (1)..(1287)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 98 - protein, 429 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 99 - DNA, 1275 bp, Homo sapiens
  CDS (1)..(1275)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 100 - protein, 425 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 101 - DNA, 1467 bp, Homo sapiens
  CDS (1)..(1467)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 102 - protein, 489 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 103 - DNA, 1443 bp, Homo sapiens
  CDS (1)..(1443)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 104 - protein, 481 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 105 - DNA, 1455 bp, Homo sapiens
  CDS (1)..(1455)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 106 - protein, 485 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 107 - DNA, 1623 bp, Homo sapiens
  CDS (1)..(1623)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 108 - protein, 541 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 109 - DNA, 1884 bp, Homo sapiens
  CDS (1)..(1884)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 110 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 111 - DNA, 1884 bp, Homo sapiens
  CDS (1)..(1884)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 112 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 113 - DNA, 822 bp, Homo sapiens
  CDS (1)..(822)
atggggagctgcgcgcggctgctgctgctctggggctgcacggtggtggccgcaggaagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 114 - protein, 274 aa, Homo sapiens
MGSCARLLLLWGCTVVAAGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 115 - DNA, 1509 bp, Homo sapiens
  CDS (1)..(1509)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 116 - protein, 503 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGK

SEQ ID NO: 117 - DNA, 1848 bp, Homo sapiens
  CDS (1)..(1848)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 118 - protein, 616 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 119 - DNA, 1161 bp, Homo sapiens
  CDS (1)..(1161)
atggggagctgcgcgcggctgctgctgctctggggctgcacggtggtggccgcaggaagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcagggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 120 - protein, 387 aa, Homo sapiens
MGSCARLLLLWGCTVVAAGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 121 - DNA, 564 bp, Homo sapiens
  CDS (1)..(564)
atggggagctgcgcgcggctgctgctgctctggggctgcacggtggtggccgcaggacgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 122 - protein, 188 aa, Homo sapiens
MGSCARLLLLWGCTVVAAGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 123 - DNA, 1083 bp, Homo sapiens
  CDS (1)..(1083)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 124 - protein, 361 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 125 - DNA, 1263 bp, Homo sapiens
  CDS (1)..(1263)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 126 - protein, 421 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 127 - DNA, 1251 bp, Homo sapiens
  CDS (1)..(1251)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 128 - protein, 417 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 129 - DNA, 1239 bp, Homo sapiens
  CDS (1)..(1239)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 130 - protein, 413 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 131 - DNA, 744 bp, Homo sapiens
  CDS (1)..(744)
atggggagctgcgcgcggctgctgctgctctggggctgcacggtggtggccgcaggaagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 132 - protein, 248 aa, Homo sapiens
MGSCARLLLLWGCTVVAAGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 133 - DNA, 720 bp, Homo sapiens
  CDS (1)..(720)
atggggagctgcgcgcggctgctgctgctctggggctgcacggtggtggccgcaggacgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 134 - protein, 240 aa, Homo sapiens
MGSCARLLLLWGCTVVAAGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 135 - DNA, 900 bp, Homo sapiens
  CDS (1)..(900)
atggggagctgcgcgcggctgctgctgctctggggctgcacggtggtggccgcaggaagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 136 - protein, 300 aa, Homo sapiens
MGSCARLLLLWGCTVVAAGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 137 - DNA, 1431 bp, Homo sapiens
  CDS (1)..(1431)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 138 - protein, 477 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 139 - DNA, 1407 bp, Homo sapiens
  CDS (1)..(1407)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 140 - protein, 469 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 141 - DNA, 1419 bp, Homo sapiens
  CDS (1)..(1419)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 142 - protein, 473 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 143 - DNA, 1587 bp, Homo sapiens
  CDS (1)..(1587)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgaccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgcagcaggacatgaggatataagaacaggcaaactaattgtgaatatgaaaagctttgtccagcactggaaaccttctcttggaagaaaagtcatggatattttaaaagagagtgcaagt

SEQ ID NO: 144 - protein, 529 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 145 - DNA, 822 bp, Homo sapiens
  CDS (1)..(822)
atggggagctgcgcgcggctgctgctgctctggggctgcacggtggtggccgcaggaagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 146 - protein, 274 aa, Homo sapiens
MGSCARLLLLWGCTVVAAGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 147 - DNA, 1509 bp, Homo sapiens
  CDS (1)..(1509)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaag

SEQ ID NO: 148 - protein, 503 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGK

SEQ ID NO: 149 - DNA, 1848 bp, Homo sapiens
  CDS (1)..(1848)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 150 - protein, 616 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 151 - DNA, 1161 bp, Homo sapiens
  CDS (1)..(1161)
atggggagctgcgcgcggctgctgctgctctggggctgcacggtggtggccgcaggaagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 152 - protein, 387 aa, Homo sapiens
MGSCARLLLLWGCTVVAAGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 153 - DNA, 564 bp, Homo sapiens
  CDS (1)..(564)
atggggagctgcgcgcggctgctgctgctctggggctgcacggtggtggccgcaggacgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 154 - protein, 188 aa, Homo sapiens
MGSCARLLLLWGCTVVAAGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 155 - DNA, 1083 bp, Homo sapiens
  CDS (1)..(1083)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 156 - protein, 361 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 157 - DNA, 1263 bp, Homo sapiens
  CDS (1)..(1263)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 158 - protein, 421 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 159 - DNA, 1251 bp, Homo sapiens
  CDS (1)..(1251)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 160 - protein, 417 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 161 - DNA, 1239 bp, Homo sapiens
  CDS (1)..(1239)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 162 - protein, 413 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 163 - DNA, 744 bp, Homo sapiens
  CDS (1)..(744)
atggggagctgcgcgcggctgctgctgctctggggctgcacggtggtggccgcaggaagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 164 - protein, 248 aa, Homo sapiens
MGSCARLLLLWGCTVVAAGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 165 - DNA, 720 bp, Homo sapiens
  CDS (1)..(720)
atggggagctgcgcgcggctgctgctgctctggggctgcacggtggtggccgcaggacgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 166 - protein, 240 aa, Homo sapiens
MGSCARLLLLWGCTVVAAGRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 167 - DNA, 900 bp, Homo sapiens
  CDS (1)..(900)
atggggagctgcgcgcggctgctgctgctctggggctgcacggtggtggccgcaggaagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 168 - protein, 300 aa, Homo sapiens
MGSCARLLLLWGCTVVAAGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 169 - DNA, 1431 bp, Homo sapiens
  CDS (1)..(1431)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 170 - protein, 477 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 171 - DNA, 1431 bp, Homo sapiens; identical to SEQ ID NO: 169
  CDS (1)..(1431)

SEQ ID NO: 172 - protein, 477 aa, Homo sapiens; identical to SEQ ID NO: 170

SEQ ID NO: 173 - DNA, 1419 bp, Homo sapiens
  CDS (1)..(1419)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 174 - protein, 473 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 175 - DNA, 1587 bp, Homo sapiens
  CDS (1)..(1587)
atggggagctgcgcgcggctgctgctgctctggggctgcacggtggtggccgcaggaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatcgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggcgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 176 - protein, 529 aa, Homo sapiens
MGSCARLLLLWGCTVVAAGKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADRKCNGHADTCHFDVNVWEASGSRSGGVCDDCQHNTEGQYCQRCKPGFYRDLRRPFSPCSCHPVGSAVLPANSVTFCDPSNGDCPCKPGVAGRRCDRCMVGYWGFGDYGAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 177 - DNA, 1887 bp, Homo sapiens
  CDS (1)..(1887)
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 178 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 179 - DNA, 1830 bp, Homo sapiens
  CDS (1)..(1830)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacaaggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagagcctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 180 - protein, 609 aa, Homo sapiens
LSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 181 - DNA, 1884 bp, Homo sapiens
  CDS (1)..(1884)
atggggagctgcgcgcggctgctgctgctctggggccgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 182 - protein, 628 aa, Homo sapiens
MGSCARLLLLWGRTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 183 - DNA, 1827 bp, Homo sapiens
  CDS (1)..(1827)
ctgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtactcctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttatccctgtcagagaaatgacctgaacgaagagcctcaacattttacacactatgcgatctatgatttcattgtcaagggcagctgcttctgcaatggccacgccgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgacggcaaaacgggggctcccaacgagtgcagaacccgcaagtgtaatgggcatgctgatacctgtcacttcgacgttaatgtgtgggaggcatcagggagtcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtgtcatgaagttcctgacttccgtcccgtgcacaataagagcgaaccagcctgggagtgggaggatgcgcaggggttttctgcacttctacactcaggtaaatgcgaatgtaaggaacagacattaggaaaggccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaag

SEQ ID NO: 184 - protein, 609 aa, Homo sapiens
LSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 185 - protein, 628 aa, Homo sapiens; identical to SEQ ID NO: 110

SEQ ID NO: 186 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 187 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 188 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 189 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLAAGHEDIRTGKLIVNMKSFVQHWKPSLGRKVMDILKESAS

SEQ ID NO: 190 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKESAS

SEQ ID NO: 191 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTPKYSSPFPCTGGEVIFKALSPPYDTENPYSAKVQEQLKITNLRVQLLKRQSYPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTRKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGKAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 192 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 193 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGN

SEQ ID NO: 194 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 195 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 196 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 197 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGN

SEQ ID NO: 198 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 199 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGN

SEQ ID NO: 200 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 201 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGN

SEQ ID NO: 202 - protein, 628 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 203 - protein, 515 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPDFRPVHNKSEPAWEWEDAQGFSALLHSGKCECKEQTLGN

SEQ ID NO: 204 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPD

SEQ ID NO: 205 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPD

SEQ ID NO: 206 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRACKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPD

SEQ ID NO: 207 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPD

SEQ ID NO: 208 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPD

SEQ ID NO: 209 - protein, 477 aa, Homo sapiens
MGSCARLLLLWGCTVVAAGLSGVAGVSSRCEKACNPRMGNLALGRKLWADTTCGQNATELYCFYSENKDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPHDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRARKCNGHADTCHFDVNVWEASGSRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWCHEVPD

SEQ ID NO: 210 - DNA, 26 bp, Artificial Sequence
  Synthetic primer
ttctagacatggggagctgcgcgcgg

SEQ ID NO: 211 - DNA, 25 bp, Artificial Sequence
  Synthetic primer
cattaacgtcgaactgacaggtatc

SEQ ID NO: 212 - DNA, 25 bp, Artificial Sequence
  Synthetic primer
agcactgtgccccgttatacaatga

SEQ ID NO: 213 - DNA, 34 bp, Artificial Sequence
  Synthetic primer
cgggatccacttgcactctctttttaaaatatcc

The invention claimed is:

1. An isolated fragment of a Netrin 4 protein, said fragment consisting of the amino acid sequence selected from the group consisting of: SEQ ID NO: 8, SEQ ID NO: 10, SEQ ID NO: 56, SEQ ID NO: 74, SEQ ID NO: 116, SEQ ID NO: 193, SEQ ID NO: 197, SEQ ID NO: 199, SEQ ID NO: 201, SEQ ID NO: 204, SEQ ID NO: 206, SEQ ID NO: 207 and SEQ ID NO: 208.

2. A pharmaceutical composition comprising:
the isolated fragment of a Netrin 4 protein according to claim 1; and
a pharmaceutically acceptable vehicle.

3. A combination product comprising:
the isolated fragment of a Netrin 4 protein according to claim 1; and
an anti-angiogenic agent selected from the group consisting of: an anti-VEGF agent, bevacizumab, pegaptanib, ranibizumab, sunitinib, sorafenib, humanized antibodies against neuropiline-1, humanized antibodies against DLL4, AM 386, and agents interfering with an angiopoietin pathway.

4. A pharmaceutical composition comprising pericytes or vascular smooth muscle cells, in association with the isolated fragment of a Netrin 4 protein according to claim 1.

* * * * *

UNITED STATES PATENT AND TRADEMARK OFFICE
CERTIFICATE OF CORRECTION

PATENT NO. : 8,420,780 B2  
APPLICATION NO. : 12/523074  
DATED : April 16, 2013  
INVENTOR(S) : Plouët et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 602 days.

Signed and Sealed this
First Day of September, 2015

Michelle K. Lee
*Director of the United States Patent and Trademark Office*